United States Patent 12,642,819 (COMPOSITIONS AND METHODS FOR TREATING INFLAMMATORY BOWEL DISEASE) - sequence listing, part 61

SEQ ID NO: 29 - DNA, 3521513 bp, Butyricicoccus sp. (residues 1-1,760,757 of 3,521,513)
  modified_base (415678)..(415775): a, c, t, g, unknown or other
  modified_base (1378356)..(1378454): a, c, t, g, unknown or other
  modified_base (1896581)..(1896588): a, c, t, g, unknown or other
  modified_base (3474303)..(3474772): a, c, t, g, unknown or other
attacagtttttccaacaacagcaaacgtgagcaggcatacttcttctgttcttcttatcgtaagaactctgatgtctgctctgcgcattacattcgtgaaaaagtggtggagcagcttgttctggaaagtatgcagcgcattatgctgaatgtgcaggcattcgagaaagaatttgcccgcaaacagatggcctgctacacagaggataagaaaaagcagctcgcggcaaaacggtgggaactggaaaaagcgcaaaagcgcattgctgagatcgacactctgatccagaaaatttacgaggataacgccagcggaaagctgtctgacgaacgctatgcgaccttgtccacatcctacgaagaagaacagcaaacgttaaaagctgccgttccggagatacaggcatatctggaaaccgaaacggataagacagtgaatttgcagcagtttatccgaaaagttaagaaaatcaccgagctgaaagcgttgacaccggaactgattcacgagtttgtggaaaagatcgtagtttacgcgccgaaatatcttgacggcaagcgtatccagattgtagacattcattacagcggcgtcgggattctcgacgaactgacaccggaagaaatggaagaatcgttccagaaatctattgcagagcgtcagaaaacagaaacggcgtaaccaataaggctacaccgtttcggaaaatgttaaattgagttgcaaaagccgccttggggcatcttccttatggagggtgccccgaggggtgtcttttttattccacaaggcccatcgtgccgttgccttcggtggtgatgcaggtcagatcatcgcggacatacagcacgacatcgggttgataatcagcgatataatcaagaatattctcgccgtcatagtggcggtaatccaggctgcgcatttcgtcgcacgaggtatacaggatgccctccaaggggttggtgaacgaatcgccgacgacgagcacacgcggcaggccgggacggtttgtcttaataatggtttcgccaatgtcgccgcccatgtagtaatcatacacgttgttgaaattttcgttgactaccgtgctggcaaccggcttgtcattatccgtgcgggtgaagggcacgggcgtgccaagcgtgaagcggtacagcttgtcatccgtggggtactcgccgagcagcttgcgggaacgggagccgagaaactgccgttcgattggctcgatggtcacatcggtggtgacaggtgcgtctatgccgagcgtctgcaagtgctccatggtgcgcaggtaggtctcatatgcgccgtaaaagttgtagtgatggtcggtttcgctgtaatatttctccggatcggtacagagatagtcagccatgttcaggcagtcaatgccgcgcgcatccagtccagcgagaaagtccgtacggatagaatcatccgcgtaggcgttaggagtgaggtacgaggggtacttgtaccttagtgcgttgctctgctcaggaatggcaagatagacaaactttgcgccgatattttcacatgcttcgtttacctcagagagtgtatctagctcgttctgcatgtctttgtggtcgtaatcagcgagtggcttaccgtgatagggcagcagcgtatcgcctgcgataaccgtgttgctgacgaccggattgtgcagcgcaagctccttgcggacgttcagccgcagcagcggaacacggcaggcaaagtggtcgctgatataggtctctacatcggagaaaaacgtgccgtccagcacggtctcgacgctcggcaccggaaagaccgccagcctgcggttttcgtaaaacgagcctttttccttcgggctgaatacactgacagccgaaaaaacggccagcgtgccgcagaacagaacggttttgacaatatgcttcgcatttttcatggtctcagcctcctcagaaacggaagtagataaacgggttatagctgctggcgagcaggcgcatcaggcacagcgtgaacaagacagccagcaccggaaactccagtacacgccatatacgggtggacttgagacgcgggaacaccggcgcggacagtacaacaccgaacagcaggtacggccagaaccgcagcagatattcgattacgaaccgattgagcggcaccgtcgaagtgaacatgctaccgaggtactgcaccgccagtcccatcgaatcgctgcggaagaacacccagccgatgacgatgaaaaacagcgcgtagaggtgctgcagcacggacggcaggcgcgtaatccatccggcgaggaatttcttttccagaatgagcagcacgccaaagtacagaccccacgccataaatgtccagttagcaccgtgccagaagccggtcagcgtccatacggcgagcagattgaaaatgtgccgtgcgggcgagcaccggttgccgcccagcggaatgtacacatagtcgcggaaccaggtggacagcgagatatgccagcggcgccagaactcggtgaccgacttgctgatgtacggatagttgaagttttcgaggaacccgaaaccgaacattttgccgagaccgatcgccatatccgagtagccggagaaatcgaagtaaatctgcagtgtgtagccaatcgcgcccatccacgcaccggcggcagacagctcgttcggtgcatatttgaatacgccgtccgcaatctgcgcgaacacattggacagcagtacctttttgctgagaccgaacagaaagcggctgatgccctcggaaaactgcgcaaacgagtgcttgcgcacggcaagctgcacgttgacatcgtggtagcgtacgatcgggcctgcaatcagctgcgggaacatggagacgtacagcgccagcgaaaacggatcgtgctgcggcggaacctctcggcggtatacgtcaatgacgtagctgagcgcctgaaacgtgtaaaacgaaatgccgatcggcatgacgatatccggcaccggaatacccagtccgaacaggctgtccgctgagctgatgaagaaattcagatacttgaacacacccagcaggctcagattggcgataacacacaaaatgagcagcggctttctatatgtactgcgcatggacagaccaaacaggtagttcatcagtatcgaaaatatcaatatgccgatcagcctgggttctccgtaaaaatagaagaacaggctgaacaggagcagcaccgcgttccgcacgcggataaatttctgcggcacgatataatagcagaacagcgctgccggtaaaaagaaaaacagaaaaatcaaactgctgaaaaccatgtagcaaacatccctgtatgataaaattgctgtcagaaaggcaaagcaaccgacaaaaagcacctttagtttaccatgctctgcgcagatttgcaatcatgcgccagatcgctgcatcgtttctgaattgttgtttacttttcccaagaaccatgctatattaaggataggctattggctgtttcaatcaaaaggaggaagacaatatgaaaaagatgagaattgcactggcatccatgctggttgctgccggtattacggcaacagccggtgcggcgaacttcacaaactgtgcggaccgcctgaaggacgtgggactgttccagggcacgaatcagggttaccagcttgacaaggcacccacccgtgccgaggcttcggcaatgctggtccgtctgctgggcaaggaggctgaggcggaaaagctgacctacaccgcgccgttcaccgaccttgtcggctgggagaagccctatgtgcagtatctgtacgacaacggcctcgccaacggcacgagcgcgactgcctataacccgaccggcaagtgctctgcacagatgtataccacattcctgctgcgcgcactcggctactcggatgccaagggcgattttacctatgccaaagcactggatttcggtgagcaggttggtctggttgacgatatcaattgcagcaccaagaatttcctgcgtgacaacgtagttgcaatgagcctgaccgcgcttgataccgatgtcaagggcagcgacagcattctgctcgataagctggttgcagacggtgcggttgacaagaccaaggctgcttctctgggcgcatttttcgcagacgcggacgcattcaacaccgctgcggagaacacctcggcggagtccaagatggctatggatatgaacatcaaggcaagcgttaaacttggcaccaccaagctgctcgatatgtccatgccgatgacgattaagaccgatatgaacctcaaggagctggacaagtccgtgatggcattcggcggcaagctgaacatgacgatcgacccgtctttggcgaacggcggcgataccagtatatcgcaggatattaactattacttcaccaatggcacttactacatggatatgggtgcacagggcaagtacaaaatggcgatgtcctttgatgatgtgctgaacggcatggagatttctgctatgaacagctctgttccggtcagtgcgatcgagagcattaccaagggcagcggcagtatgaccgttaagtacaacatgaacagtgtcttcagttccgacctgtttgatgagctgctcggcggcatgctggacggtgtttccattaaaacccgcgatatgaatgttaccgcgaaggcagtcaatggcatgcttaccgataccgcgatttccggtacggttgatattacggcagagggcgagaccatcagcgcaaccctgaacgcagccgctaaggtaaccgctaccggcgatgcggttaagattacgctgccgaccgatctggacagctatgtcgatctgccgaccgagattaactgacggcttgacaattccgcaccttttatgataaacttatctcactaaaatttgtgtggatttttacagcatctcaagatgttctttttcgccgcacgaccgggattccggccgtgcggtttttttatttgcacaaaagggaggaaccgaacgtgaaccaacgctttatgcgggaaaaaccgatactgccgctgctgctctcaatggcgctgccgatggtggtttccatgctggtgaactcgctgtataacatcatcgacagcctgtttgttgcaaaaataggagaggacgcgataacagcgctgtcactggtctatccggtgcagaatttgataaacgcgctcgctatcggcttcggtgtgggcatcaacgcggtgatttcgtatcatctcggtgccggtgagattgatagggcagacgcggcggcgacgcgcggtattgcgtgctcgattgtccacggcgtggtgagcatgatcgtgtgcatcaccgttatgccgcgtttcctgcggctgttcacggattccgagcaggtagcggagatgggtacgcagtacgcgtccatcgcgttcgcgttctcggtgattatcatggtcggcctcgcattcgagaagatttatcaggcgatgggtcgcatgcaggtgaccatgacagcgctgctgttcggctgtgtgacaaatatcgtgctggatccgctgctcatcttcggtatcgggccgttcccgcagctcggcatgcgcggtgcggcactcgccaccggcatcggccagctggtaacgctggcgttctatctggtgatatatcggctgcggccggtgtccgtgcatatcacacgcaaggggctgcacggtactcgaggcatcacggcacggctgtatgcggtcggcattccggcggcactcaatctggcgctgccgtcattgctcatctcgtgtctgaatgcgctgttggctgagctcaatcaggcgtatgtggtcgtgctcggcatctattacaaattgcagactttcctgtatctgcctgcgagcggcattgttcagggcatgcgtccggtgatcggttacaactatggtgcgggtgagcgggaacgcgtcagccgtatttttcaggtagcgcttgcgctgtgcgcgtgcattatgatgatcggcactgtgctgtgtctggcgtttgcgtctccgctgatggcacttttcaccgaaaatatccggacggtagtcatcggtgcacatgcgctgcgcattatctgtgtgggatttcttgtttcggcggtttcggttacggcatccggcgcactggaaggactcggaaagggtacggcgtcactcgtgatttcgctgtgtcggtataccgtggtcattctgccgatcgcggtcgtgctgtgtaggattatgggcgcgaatggcgtctggcatgcgttctgggtgacggagtttatctcggcaggagttgcatgggtcgcttggaagcgagtgtaactgcgctgacgccgcgcccgcggcgaatccccgctgaggttcagcgaaaaacttcccgcccgtcaggggcgaacacgcttgcgcagttcgtgtgccccagttaatcggtgccgaaaaagaagctgcccggatagggcgaacacgcttgcgcaattcgagcacccccggtcaatcggtgcagggaaacagcggaaatgtcaatagtaaatgcgaaaaaaatataaaaaaatataatcaggcttcccgcgccaattcttcaaggcattccgcaaacacgatttcagcagttttccagcctaatatttcacgcggatagttgttcatccattcttcggctttcttcacttccgctcgactgaccttattgaaatcagtccctttcgggaacttccgccgaaccattttgttcgcgcactcatttgaccctcgttcgcaacttgtgtacgggtggcaataatacattttggttcgtctgccttttcgtaggatagactgttcaaggctcttcacgtcggagaactccccgccgttgtctaccgtgattgtctggaacacgcgtggaaacagcgtcccgaacctccgttcaatgcggttcaaggcgcgaacggtgctgattgcggttctgtcgcgcattttctctataatttcttttcgtgataggcgttccgtcagcaccaacagggcgcacgaaccgtccttgccggaatatacagtatccatttcccaatgcccgaaagtgattctctggttaatcacttccgggcgtttttctatgctctctccgcgcggtgcgcgtttcgtcgttttaactttgtgatatggacgcttccgcttcggcttttctggtaagtctttattcgtcaggttcagaaacacacccttttcaatgtaaccgtaaaaagtgctgacacaaatagaggttttgaacgtccggccctctatcgttatgtcagcaagggccgcggcaggcgaacggtcttcttctatgaccttgcgttccaaatagtcagcaagttcatggtcgtttccgattttcaacggcgcacctttcgccgcgagattttcacggtatcttttttctgctccgtccgggttatagcggtcttccataatccatgtatcgccgtccagatgctcccaacgggcgcgtttgatttctctataaatcgtgctgacatgaacatgaagttccgccgcaatctgcttcggcgtatcgccgcggttcaaaccgtattcgattttccgccgatctgtaagctgtaaatgactgaaacaatgccccatgctataacctcccaaaacgcgaaacccgcccatgctatcaagccgggcgggttttgttcctcttttcagcggttccccgcaaaaagattataacaatatttttatactaacgcaagtataaaaaaactattgctcattttctgtcagccattccatagatacgccaagtatcttcgcaagcaccgcaagttcataatcggtcacaaagcgggtcccgatttcaattctgcttacgctgtcccgctccattgtaattcctgcaacttgtagacgcgccgcaaggtctgtttgcgtgatattcagccgggcgcgtgcttctttgacgcgatttccgcaaaggttctttcgtcccttgtagtcgtatatcttcaaccgccgattcctccttttgtgttaaagggccgtttgtcaagagtaaatgcacaaaaaagcaaaaatattttttatgaggccagaatgagggcgatttcttcccggaaaagctgctcggagcacagataaccgaacattttgcgggggtagttgttcagccagtcctcgatccgcttggtttcctcgtaggggatcgtgctcaggtcggtgcccttcggcaggtgccgacgtatgaggccgttctggttctcattggatccgcgctcgctcggccggtaggggtggcagtagtagacctcggtgcgggtgcccttgccgctggcgcttcgttcgatcccggcggcgtcggcaaactcgcagccattgtcgcaggtgatggatctgaataccttcgggaacaggtcgccgtacttggcctcgagcccgtcaatcgcagcgacgacgctggcggccgtcttgtccggcgacggtataatgagctcccagcgcgttttccgctcggtcatcacgatgtaggtgttgctgacgccttggcagctctcgacgctgtccatctcccagtgaccgaaggtgctgcggtcgttgatgtgctcagggcgatcctcgatactccggcccgcaggcttgcggggcatggatccggccgggcgctccggctggtggcgcttgccgtgctgcggcagcatggagacggtcagctcgtcgccgaagatctcgccgcggatgtagttgtaggcggtactcgcgcagatgtgggtcttgaagggccagcccttgacctcggcctcaccgattgcagcctccgggctgtacttctcgtcgcggatctttgcgatcaggtagtcggccagctcgtagtcgttgccgatcttcagctccgggcccttggcgcggaggttggcctcatagcgggcctgtgcgccttcggggttgtatctggtctcggtggtgtagtcgctgttgaggtgctcgtaggtgcaccgcttcagctcccggtagattgtcgtatggtggacgccgagctccttggcgatgtccgtcggcttcattcctgcgcggatgaaggcgtcgagctggatgcgcttggtcggcgtcagatggctccagtgctgtcccattgtgttcccctccgtgataaaagaaaaggggcggcccgccggccgccccttctgtgtgtcagtgttcctcgtactttttcaggagctcgagcgtctcctcgtctgtgatgatgtcggccagcctgcactccagcgcgttgcagatcttcagcagcgtcggcagctttgcgccgttgatgtcccgggcgccgcgctcgtactgctggagcacctgcaccttgatcccggccagatcggcgagttgagactgagacaggccggcagccttgcggagcttttgcagcccttcgcttttgtaggtcactttgattgagatgtccatgttgttcctcccgcttgactttgccgtggtttcgtggttataatgaaaaggaacggcgggcgggatttttcccgccgtccttcgaccttactgcttgggcttttggttcggctttattgtgatcgtaatggtggcaacctgttcacactttagagcctgttccagcagctcgagcagttttttcatctgctcagcatccacggctttgcctcctttccgcggttttgttctcctttctttctgtactcggctatcccttgcctgtgattatattatagagcatttgctctataatgtcaagcataattcggcagattttcaacattttcccgcgattttccacgaaaaaaagccgcacggcgtcgctgccgtgcggttttctcattctttcccgagcaggtggttgatggtggtgccgagagcggtcgccagatagtccagctcgtagtcagcgacgactcggctgccgttctcgatcctgctgatgaccttctgtgtgacgtccagcccgatgatctggagcttgtaggcgagctgttcctgtgacaggtttgcccgcagccgctcctctctgactctctccccggagatgttgcacctgccgtctggtttgtatatcttcgcagccctcgcctccctttacgctaaagatgactatgcaatattgactttaccagttttggcatggtaatattatgccaaagatgactaaacactaataaatacaaagtcatcaggaggaggtactgcatggggctgtttagctttctgaagaaaaaggagccagagccggctcctgcgatcacggccacgatccacgctcagaccgtagaagtgaagcaacggacgcacggcgagctcccgcttgccgagatcggcggctatgtgagcccgtccggcggttttgtaaactatgggcgtttttgcgttactggtatgaactccagcacagggagaaagaacacgaagcgatacgaggcgcagaccgaggctgacgccagagctgcggctgcggatgatggccttgtcgagcctatgactgtgcaggtggagccgcagatcccgccgaccgatcgacaaatggactacgcgctcgaactcgaggccatgctccccgacggagtatgcaaggaggacgtcagcgcaatcatcagcaggatcaccgacgaggacgaggctgcaccagatcccggcctttcgttgtatgcgcacgcctgtggggtgaagttttcgcgctttgtcggtgaaaaggctctgctttcgtatatggtcagccagatgcacggagccgctcggggcgagttgtatgcttatgccgtttaccggcaggagagcggtggaaggttcagtgatccgcgtggtctttcagtgtatgagtttctgcacagttgcggggctgagattgctgaagatcctgccctgctgaagtctctggaggatcgtgatgtctatgacttcgcaggcccgaacagaggcacgaaggtttacaaaatggccgctgccagattgaagcagtgcggggccctataaaacaggaaaagcccgcccgggatctccgggcgggttttcttgtgctgtgaagttgtggatcagcgtgcgagtgctgcgttgacggcctgctggacggcgttatagtcgtagccggcggcctcgaggcgcttcttgcggtctgcgccgttgccccacttgccggcgatgacctccttggcgatctcggcgatggttttcttgggggctgcggttcccgggatcttgatcttctggccgactctgatgatgttcgggttggtgatcccgttgtacgctgcgagcttctggtaggtcgtcccgtacttggccgcgatcttgctcagggtgtcgccggcgacgaccgtgtaggtcacttcgctggtggtgccgccgctcggcgtctggctgcccgtgttggcgtttccgggctctgcgtcgtaggccgggcggccatagccgacgatgtagttgtcgctcaggtagtaggagcggcgggccacttggtcggaggtgttgccctcgatggtgtagaccttgctgccgtccactttctcgacgaggccggtgtggctgacgttgctcttggagtgcgcggtgctgaaaaagatctggtcgccgggcttgggatccttggcgtgatagcggccctgcttctcgtagtacatgagggagtaggtgcagccggcgcccgcggatctctcgggctggcagagcaggcgcagcgcgtccgcatatccgaaggcggtcagcatacaccagtcgacgaacatatcgcaccatgcgaagccgtttttcttgccgttgtaccacttcgggtacttctcgtcgaagtctctggcgtacttggtatagttggcgctgcctgcgttggcggtcgggttgtcgagctggctgttgctctttttctcgtggtagccgatctctgccgcagcgatggcgagaacggccgatgcgtagcatttgctcatagttttacctccttagctgtaaaaaagaaaaagggcgggccggagcccgcccctctccgtcattcgatagtcaggccctcggtgttgagctgcttgactgctgcctcgatcgcgttgatgacgctctcctcgtcgaccttgaagcccttctgcttcaggaagtcgatgacgtactgcttcttctcctcgccgcggccggcgcccttgtagagctgctcagcagcagcgacgccgatctttacccacgcggtcagctccttgcgctgtgcctcggtggtctggctcttgagccacgggatcaggaaaacgctcacgccggcgccgatcagagcgatggctgcgttgacgataggggtgatgtcgatggtgttcatccttttgcctcctcattgttgagagtgtccccggacggatccgggagcgggttgccgtcggcgtcgagcctgtggcggtttcggctgattttctcgccgaggctcttgccggcgtatgtgattagatagccgacgcaggcggtgaagatcgtgccggtcacttcgctgaccgggtcgcgcccgaaggctgagagcaggtaggacgtggctgcgctgaggcttgccacgatggccgcccagtatgcgagcttcttgctcgcctcgatcttctttttccgcttgcgccggcgcttctttgcggccatactgctccacctcctcagtcgatgatcgcgtggatcccctgactggtgaggaagtccttctgcgcgtgcttgattttggcagcgtagtcgagggccgcgtgcatatccccgttacaatgcgcgtcagggatgcgctgcacggcccgggccgtcgcctcgccgagggcgatggctgccgacgtgccctgaatggtgatgatctggagatcttcacgggcacgctctcgggccgctgcctctttctgtcgtttggcctcatcggcctccttttgcttctcgcgcttctggatcctgtgctcgagcatccagaagcagaagccggtcacggccgtcgggatccccagtaggacgacgagcgcgccgatgttgatttcgatcattgtgtcacctcataaaagccggagggccgcaggacgcggccctccttgttgttgggcttactcctcgacgtcgtcgaagtagcccatgtcgacgagatacttgtgcacgcgggccttcagcttcgcggggacgttgtcctcggtgatgcggcccatgatgatctcgcctgcatacagacgtaccagcatttcacgctcctcctttcctgcaatttttaataatagccacgcgagggcccgggcgatcattcgctcgccccttcctccgcggtgccagcgtttgcggctgcctcgatggcagcgatggcgtcctcgacctgcttgcgcagcttcttcgggacgtcgttgatggtcatggtggagccttcgcgggtcagctccttgacgtacagctcgacgagcttgctcatgctgttacctcccctccgtcgccgtagaccacgtcggccagctccatgatgcagcctttcagcagctcgatggtgtcagcctgctcggcgatggttttgcccttcttggcctctgcggcctgtttctcgttcagctctttgatgctgtcggctctgtgcttaatcatgcaaagttacctccgatcgactggatgtagcaggtctccgtagcagagccgcggagcagcttggccttaaccttgacgccccacgctgcggccgtcttggtcttgtttgtgaagtagtgcttctggccggctctgaccttctgcgtgatgtcctcccacgtcgggctcgcgtcgttgccgttgttgcagatccagacctgaagcgtgcagccggccgggaaattgccctgaatgttgacgagggccttggtcggcatggcgtcggcctccatagcgagggtctgctcgaactcgacggacgtgacggcctttgtgaaggtcagcacgcgggtgacgctggcgtccttggcgtcggtcgccacgatcttcagggtgtggctgccgttcacgaccttcagccacgcctcggagccgatcgtcagcgtgttggtatggccgagggtcacggtgtagctgcgcagcgtgacgccgtccagcatctccacgacgtcgacctgatggccgtcggcgtcggtgacggtgtactcgtaggacggggccgccgtgctgaagctgccgagggcgccgtccgtgccgctgatgacgggcggtcggttattggtgacggtgcgggtgacgctggtggtgtacgcgctctccgcgccggcggcgtcgtatgcctttacgcggtactgcacacttgtccatccgtaggtgatggcgtcggtgtagctgcgcgaggatcccttgtagatctgcgcccatgtgccgctcccgaccttgcgctccagaacgtagccggagaggttgccgtcggggtcggtggaggccgcccacgagatgctcaggttctcgccgccgagcacttcgctcgggacagtgatggacgacggcgctgtgggcgcctgattgtagatcactgtatagcatccatccgagtcgacggagtcggagatcaggagatcagaggacagattacaagcggggcgcaggccgaggtagccgttgaaggcgtagttccagctcagagtgccatcggcgtaaacgtagcgggcgtagtcggccgagccggcataggcgtcccgcagccagtagtaccacgcggcaccagagcccgggttgccggaatagttggaattggcgacgcaggaggccgtcacggtggcgatgcggctgttgttgtcgctgaagatcgccagcttgctgccgcagacgtggtcgccgctcaggccgacctcagtgcaggacagggggaagatcttgtccgtgcaggtctccgtcccgccgccgtctgtggagctcttgccgaccgtgatggtggtgttcagcagagccgcccgctcgttggcggtgaaggcgttcagaaaaccggcgaggccactgtacgggttgacaccgttccagacgtgggaggagtccggcgtctggtctgcggagtgctgtgcggtgtaccactggccggcagccgcggggctgttgagccactggcgcaggttcgagtagatgtagcggttgttgccgtagccgcggcggtcgctgttgccgttactcggttctgttgcgtcgaagcacagcatcttgatgatctggttggtcacgagcgtgacgctgttggaggggtagcctgcgtggttcttatcggccacgatccagacgatctggctgccgtacaggctgccgaacttgaccttcgacttgtttgcgaggttgctcagtttttgggccatgagttgtgtctcctttcggtgatggtttgagctccgggaaatagctgaagaaataggcgtccatgttctgccgcaggtggtaggtgttgccgtgtgagatgtggcccgtccagctcgcgtaggattgcacgacgctgtcgagtgtcatcttgccggagtccaccagcccgcggaacttgcggatcttgcgcttcatgttgtcgatgctcttggctcgcactttcctcacgaccttgccggtctgcgtgaggtaggtgtgaaaaccgaggaagtcgatgccgttcttcagcgggagaatctgcgtcttgccgttcagccgaaggccgagcggcttgatgtacgcctcgatctccttgagtatctgccggagcagcagcttgtcactgtggatgatgtagaagtcgtccatgtacctgccatatacgaggccgcggtcatccctcagccagtggtcgaaggcatccagatagagcagcgcgagcagttggctcgactggttgccgatcgggatgccggggtctggcgtgctgtcgattatgagccacagcagccactcagcgaagtcgatcagctcgggatccttcagccacttcagggcccggcgggccgtttcgtaacagtaggaatggagcagggtgtaaaagaactttgaaaaatcgcccttcagtacccagccgtcggcgtagtcccactcgttcatcggccggggcggcaggccggcagccttgcgggctgcttcgtctgctgcctttcggctgaagaaatagtggcgcatggccgcagccagacggtcgaggccgtcgtgggtgcctttgccgatctggccggcgtagttgtcccggatgaagcgccgggagaacgccggctcgaggacgttgtcgcagagcgagtgctggacgactttgccctcgaagtcgatggcgaggacgagccgctccttgggctcgtacaccttgaaggggtagtagggcccgaaggaatagtcgcgccgctggagcctctcagagagggcgacggtgcgctcgatggcctccatgcggtagcgcatagcggtcgggttgtcgcgctttccgcagcgggttttgcggtatgctttgtagagcgcgatggtgctgtttacgatattctccattgaaaagtctccccgccgtgtatagctccggccacgctttgcgtgcgccgccgggggcatcggcggtcttgtgtttacccatgaccgggccggtcagacggccgcggctgcgggagggatatgccttccttggatgatagggcacagtgttcgccgtccgtctccgggcggttaataagtcgggcgatccatcgaagcggggcgcaggccgttgttgccgttgtaggcgttgttcctgttcagagtgccatcggtgttgacgttgcgggcgttgttggccgagccggcacgaaaaaacaaggcataccccgagggccgcctcactggtgacgcttctgtgcgtccagcttggcagccctctctttatccgttttgtaccatttggcggtctggttcttcacgccggccgccatcttcgcccagtatgcaaaggcgtcatcgctgaagccgctgaggatctcatgcgcgagctcgatgtggtggatcagctttcggcagttgcgaagcgccgaccgctgcgcgcgatacctgagctcacgctcctcgggatccgtcaggagcagatcgttggcctccatcagatcggcgacgaggtcgctggcctcgttcatcatcctctgcgccagaccgagccgctccttcttcgggaaaacggccgggtttctggtcttgatgtaggtgtgtttctcgagctccttggcgtccgtgatgacctgcatctcgggcagtttgtcacggccgaagggcgggcggcctacattggcccgctcgtatggccgcgagtgtccgttgcttgccgtagtatctcacctcctcgcctttgattgtgacgcgggcgctgctgccgtcgtaggtcttgccctgaatgacgatgacgccgtcctcccgcttgcagcaggagcagggcagggccagctcgacgaacaggtgcgcgatgatgcaggaggcttcggctggtgggattggggtgtagttgtagcagtttcccatcagcactcgagcctttgaagcgaagcgttccagacgccagacttcagcgtgatgcctgttaagtctgcgaatgtgatctggaacgggttgcttgtgatgtcgctgaaaacggcgtcccacagcgttgcgatcttgctggtgttctggccgaccgcgttgctcaggtcgttggccgatgcctcggcagcctgcgcgattgcgatggcctgccgggcgagtgccagagcctcctcggccgtagcctgcgcgccgagggcgatggccttgtaggtctcgtagtcctctttggtggcgtaggcgtcggcggggatgtaggcggtcacgttggtggccgtgccgatcgcggtgacgatgtcgatggttttctcgacgatggtggcgccgccggagggcgggatccactcggccagatcgccgcagttgccgtagcagtacagcacctcgccgacctcgggatcgggatcctcggcataaaggccgagctcgcggtagtagaagccctcggtctcgtcgccgttggtgaagatgccgccgacggccacggtgccgtcgccgttgatcttcagcttcgtgatgtcgacggtcgccttcgggctgaccacgccggtgagggtgcggggcgtctggccctcctcgaggtagccatcgccgaggacgatcttggtgtagttgatcttctggccggccacgcccttcgccagaacgatcaggccggcggtggtgatgtcgttgttgataaatgcagccatgtctatctcctttccttagtctgagatgaccgccgcgtcggtgccgatgctgacggtctcgcggttgttgtcgtggacgacggccgcgtggtagatgtggatctcgtcgctgcccatgacgtgcacctcttgggtgtgatccctgacggccatgccggaatagaggaacatttcgccggtcaggcagatcaggatcgcgtcgagccacgagctgcggcgcttgaccgtccgcagcagtttcaggaacaggtcgaggttgctgttgacgaggctcgggttgtcgctcagcaccttgaagtgatgcggctgcccgccgtactgataccactccctgacctcgccggtgccgaagtagtcggccacgatctgctccacggcgtagggggtgccgagtttcgcgtagacgcggtcgctgttgcggatgacggcccgcttggctgcgatgggcgcggtgctgtcataccactggatgttcagctcccacgccatttcgtcgagctctgcgtcgctgagctggtcgatcttgtcccacctgctcaggagcttcaggcgtgcatagacgtcgcggctgataatgtcgcagccggtggcgatgcccttgtcgctgccgtcctcctgcatccacgcaggcagcagtttgaccatctcggtctcattgagccgcatttacaccacctcgctctcgaccttgtggccgacagtcaggtggccgctgaatttggcgacttgcgtgtcgtcgagggccttgtaggtcggcttgacgacgtccacgcggaaggcgccggtcaggttctcgccccacgaaggcgagaggatccgcttgcggagctggtcggggttgatgtcccggccgagggctgcgacttgccactcgttgtagcggtcgatcgcgccgccggtgccttcgacgttggcgatcacctcagcctcgctctccggcgtggtgtagtacacgatctcgatgtcgtaggtctcgacctccgggggcacggcgctcaccttgtcagtgagcggccggatgtccttggcgttgaccacgtccagcaccttcgccagcatggcagcgtcagggatcccgccgccttccagcaggggcacgatcttgacgcagccctccagcgtgcgggtgatgatgatgtcgatgctctcggcggccgagaggttgcccttgagcgtgatggtcagcaggccgtcggtgtagtcgacggtgtagtccgtgtccttgaccgccgccgtgctctgcccgtgggctttcacgacgagggtgtcggtcaggagcgtgccgccgcccttgaaggctttgccgtcgtagaccgtgagggtctcgctgacggtttccttctcgctgacggccctcgcgtccacgatggaactgtcggccgtcattacccagtagatgtaagcctgttcggggcccgcggtggatctcttggcgggagccagacggatccgctcgcggaggcggttgtcgccttcggtggtgtagggttcgccgtcatcgcctccggctgtttcggtcaggttggtgacggactcgatgtaggggatcaggtcgacgagggtgccgatcgtgccggctgcgtagccgttgaacttcgtgccgttgctcacggccgaggtcggcacctccacagagtaggcgccagcttgcagcacagcgatctcgtcggtggcaaaatagttttcgctgtccggcgtcaccttcgtccatttcggaatgatgatgtttttctcctgcggcgtggagacggagaagcgcatggtcgtcttggccggtgtgccttccagtcgtttcacgtcctgccgctcgccgatggcgtccagcacctcgcccctcgcatagcggagaagcgtctgccggccgacgtcgttgaggctgttgtagagggcaacgaacacgggcacgagagcctcgccgaagatccggcgctcgtcgcccgggtagagcggctcgccggcgcccttttcgagctcggtgatgatggtcttgtatagggtgctcgcgtctgtcgtggtgagtttgatgtcctcgccgtagatatttgtcgcgtcgctcacgctgttcacctccttcatgtgatgttctcgatgctggcccgcagctcgaagtcgccggtctgagcggtcagggctttcaggtcggagtcactgagctgcacgcggggctcgtaggtttccacaacgaactccacgtcggcggccagatcggtcgcagcggtttcgctcggcttgtcgatcagcgtgcggtcgatccccttgatgcgctcgtagggcacctccccgcggatggtcttgaggaggttctgcacgcagatctcgggcgctccgttgccagatgctttcattgggatcacctcgctttacttgagctgcgcattggttggctttttggatgctttggcgctgctggaggctccgacgttcacagccgaggagcttatgccgagctccttgtaggtggcgatgcctgccgccgacttggagctgctgccgctcttgccgctgttgccggattttccagaactggcctttttgctgctggcctcctcggcgtactcggtcagcttgatcgtgatcttgccggtcaggatcctgccgaggttgtccagcttggtgtctgataggctcacgcccgtgagctgaaggttggccgggccgaagcgccggccggccagatagaatggggcatactgcccgaccagcgccgtccacgactcgtactcgctgcgcacgtcgcagccgaccgcggcggccagatcgaagtcgaagctcatgctttgcagcttgagcgccttggtcttggtcgccggggatccggctttgtcgtcgctgttttccgtgtcgagctcgacgctgtgggagatgccgttgagtgcggcgatcctctggctggagacgccccacgtcttgccgttccacgatgccatgacggccatgtctatccctccttactgtgggccagaagtggtgccgcctcggctgtctgtgtgagtgtggccggtcaggctgatgcccgtggctgtcacgtctgccgacgggacgctgatgcccttgtcctgcatcgtgagcgcgcccttcttgacggtgatgtcgcccgggacgatgccgccccactctccgtccatgcgggagaggatgatgccggtgccgtcctcgaacatagcgtaggcgacttctgtgccgggggtcaggtttcccatctccccgcgcagataccacgggatcgtcagcggccgcgtgaccatgctgtcggcggtgcttgggagcactctggccgtggttttgtctccgttcctgtcggcctttccctccacgctggagatcttgcccttctggatcatttggttgttgctgttcatcaatatccctccagtggcttgcggaggtatagcttgctccgcgtcttgacgtagtcgtgccggatccggctgatgaaggccgtgccgtcccacgacttgacgccctcggtcgccagcgtgaccacagagcccgccgcatagtctcgcagcagcgagcccgtccaaagggtgccgacggtcgcgtttttgttggcgtcccggagcaggcccttggcgaagcggtcggcctcgctctggtcggtcatgcggaagggcaggatccggcgcagtaccttgtcgccgccgctcggggctgtgaaggtgccgatcaggccgccgttgactgcttcggccgagccgtaggcgttggtgccctcgtcgcggtactcgaagtcattggccggggtgatggtgatggtgtcgacgggctgctggctttccatgcgcgcctcatcgtagacgaccagctttccgtcgtacaccagaaacgccgcgccctcgagggtgcagcggttctgaaaaaatgcgaagtccgcgagattgttctgctcgacgtagtcgtaggtctggtcggtgatcccgtaggtctcgagcgtcaggccgtgacggccggcgatctcttgggccagttgcaggaacttgaccttttcccacgatttgctccgcgtatccttcgcagactgcgggacggaataggcccgcagggtgatgatgccggactcggggacgacgctttcgacgaacattttgcccgtcttggcagcgccgtcctcgatggcgatggtgtcgcccttcttggggttccacgagtcccacagctcgcgggtgtcgttgagtttgagtagcagctcgtcgctctgcttttcggcgtacatatcgtgatagcagcggtggacgctgatgtccgggtagatgtcgacgccttcgtataggattttcacggcgtcacctcctccacggcggcagggtctccggcgtctccacggtctcgacgatcgggatccgcacagcctcgccgccctcgaagatcagcacgtcgctgaggtcggggttggcctcgatgatggtgcttgccatgcgctcctcgttataggcgacgagcgcgatgctgtcgaaggtgtcgccgccctgcgccacataatcaataaagccgactgtctgctgtgacataggcgccgccctcccttctgctgagtgcctcgaggatgaagtcgatgaactccggctcgaggtcgcggagctttcggatcagggcgtcctcgtcggtgtcgccctcgatcttgatctgcggggagaaggacagcccgctcaggtcgtagaccacagcggtgccggagccgccgctgagcagctcgtagtcgctttcgccgtcagatgctccgagcatccggcccgcctcggcccagtaggacaggttttgcgagcggtatgcagggttgaagctgatgacggcctcggtcgggtagtgcggatcctcgccagcgatggacgggcctctcgtgaagccgccggtcgcatagccagagacggacgcgctgccgccgcccccacctccgaacaggccggcgatcttggagatgacgccggagccgaagctgacaatcttcgatacccagccgacgatcgtgccgagcacgctggcgatgggctccagaatagacagcagcggggtcagcagtggggtgatggcaccgatcaggctcaggatcggagggagtagcgcctgaacgagttgcatcaggggatcaagcagcggcatgatgacgctgttgacgatttgcagggccacctccagcagcggggtgatgaccggcagcaggctcgagatgatgctcaccagcacaggcagcacggcgctgacgatctgcgtgataatagggagcacggtggcgagcaggctggcaataggcggcaggatcgcggaaacaatctgcatgagtggcgggaggagcgtctgcacgaggctgagaagcggcgggagcagagtgctcattagctgcgtcagaacgggcagaaggtcggccgcgagctgagagatcaggggcagaacgtcctcgagggcgtcggccgcgccggtcaggaactcgtcgacaaacggggccgcagcctcgaccgccttggagatggccggagtgatctgctccatcagcttttgcagggtcggcatgaacttgttgagcccgtcgaacacagtgttcgccataggcttgagggccacttcgagcccctgcttcataacctgaagccgctcggcgaagtcgtaggtgtcatcggctgcgccggcgattgtctcgccgttttcttgcagctcagccgtcaggtctgcgacggccagagagccgtctcggatcgctgcggccatcgtggagcccgcccttgtaccgaagatctccgacgcgatgctggcggcctctgcggccgtcccggcgtttttgatcttttcgtagtacatggcgagcccgtcgctggcgctgatgccctccttggcaagtgtggcgacgctctttttcatggcgccgagcacttcgtcggtgtttacgccggctttgtcgagctggcccatcagggcgctcgccgtctcgaaggagtagcccatctcctgaagctgcgggccgaacttctgcatatctgccatcagatccgtgaagcccatacccgtgctctggctgaccttaaagatgtagtccatagcgccgcccatgtcgtcggcgtcgatgttccactgttggaaggcttggctcgactcctcgatcacgctgccgaggtcgtccccgagcatatcgctcacttggatggcctgcttggagatctcctgaagctgcgggccggtgaggccgaggcgggtgttgtagtctgcgatcgccttgctggcgtcctccattgtggtcgggacgctcttgtagacggcgtcgaagtcatccagaagcccatccagcgcgtcgccggtggcgccggttccgatgcggatagcatcagcagcgtcatcgaaggacgcgccgagatccttcatgtactttccggcctcgacgactgccttgcctgtcgccacagcgatgccgcccacggctgcaccaacggccagcgccttcacgttcaggccgctgattttcttctgagcctgttcgatggctttgccgagtgatgggtcgatgctgccggccagattgacgaccgcctgcatcgtttttccgtttgccatgtgcgtcacctccttctgatgtggggtttcttaaagctggccgcacgagtcggccggctcgcttggagccgcttggcctcctcgacggcctccccgtattcggtcaggaagtcggtcagccttcgctctccgaggtctcgcgtcgacgtgtggaaggctcgggcgtagtctcggattgcgcgtcggagctgtcgggggtgtagggttcctccgacttcccggaaataaaatcccggccgatcctcataatcttcataacgtcgtagccgcggacgcgctcgaggtcggagatgtcgatctcggggttgatggcgatgatggcagcgaagccgaggtagaggtgcaggccgtagtccagctcggccgcgccggccgcgttgccgttcttggagccgctggcgctcagctttctggcgtcagcttcagcaaacgcctgtgcggtgatctcgctgatgtcataggtcagctcgtcgtagctcttgccgttgatctgcacggggttgtcgagcttgatggtgttcttcattgggtgcgtctcctttcgataaatagagggcgccgcataggcgcggcgcccttcgggttacagcaggctgcggatgtccttggcgtagtcgacgccgccgacgcgcaggatcgtgttgagctggtcgatcagccagtattcagcgccgccgacgtagagctggtagcggctcacggcaaacgtggcctcgttctcgctggtgttgccgggatccacagagaggcccgggatgcccttggagacgcagcggaggaacgccttgcagccttcggtcttggtggagccgtcggcctgcttcacgtcctgagcccagcggatctcgatggtcttgctctcgagcttcatcatgttccgcaggccgaggtcgatgccgatcttggtgatggacgcctccatagcctcgatctggccgaggatgggggcggtgtaggttcccatagccttgaagtcagcggtcacgggagtgacggccggcagcgagatggtcacgtctttggcgacgagggtgccgccgatgtagacggtgtcggcgaggatagggcccttcaggtcgagccacaggtttgccattactcgtcacctccttcgtagtagacagagaagcccgcgtcggtgtatgcgacgtagacgctcgcagacttgaggggcggggtcggggtgacggcgatgtcccagcgaaagtcgccattcatcacgtcggtggtgctgttctcgctctcgaggaacaggatcacaggctcgcccagcagggcgcccatgctcacataaccgtcgagcttttcctgctcgcggttgatgatgcgatccttcagagcccgggtcatggggctgtcaatctcagggctccactcgcgctggaaactgttggtgatgtgcatgagcatccgcatggagacgtcgaagatcgcgcggggatccacgtctgcgccataggtataggcggcggtatggtcgccccacagtacccactcgccgccccacgcgacggcggtgctgatgccgttctgcgtcagctccttgccggtctgctggtcgaagccgcggttgttggcgttggcgccgaaatactgcttgatgatggggatagccttgttgccgcaggtctccatcgggacgctgttgtggctgaagtcggcgcgcatgagctcgaccacggccatcgtgctcaggtggtacacgttgccgagattgtccacgccctgcggccagtagaccttggagcgctcgccggtgaaggcgttggccttcttccatgcgattgccttggtgatcgtgtcgaccgcctgcgcggtgctgtccacgaggggcaggtcagccacgacgaaggcgtcccagtggccgttgatcttctggctggccgtcagcatagcattatagacggcaggactgtggctccagccgggggccgcgatcagattgcagaccgcgaactgctcgggatagagcagcgtgatcgcgctcaggccgctgtattcgccggaggaggtgacgccgccgatgatgtcgctgtcctcgacgctgtcgtccacctcgtagaaggtggccgtcaggttgccggtgagctgcgcgtcgtccttcaggctggtgatgatgaccgtgcccttggtaaagttgtagtccacggcgtagtcagagccctcgacgtagttgccgctggtcgcctttgcgatggtcagcgtgtcgaggatgatcgtgctgctggcgaactcggcacggccgccggtgaaggcgagggtcttggtggtggcctcctccttgcggtgctttccctcagaggggtcgagcacgttgatgacgtagatcgggccgatgttcccgagggtgttgttgaaatgtgcgtacataacctcgcacagggtaaaggtgccccagtcggccgcgtagccgagcttcttctgcgcgtcgaccagactggtgatcttgatcggcgcgttgatgacgccggctttgccgaagccgcgcacgaggttgacgggtgccgtgccgatatagaccggcgtggtgcccgcctgcacggcgctctgtgccacagtttcgccgatgtggccgtaggcgccgtagaggtattcgtttgccatctgcttatcctcctttgcatgaaattagggcagccacagggccgcccttaaagcaggtgttggtagctttccgggttgcgggtcagcgcctcctcgacggagaactcagcccacgcaaaccagtacgggtaaaagtcggggacggcgtcttgctcggcgacggggccgaaggagatgccttcctctttgatgacgcggaggtcgccgaggtactcggcgttttcgatccgtcggagggctgtgtccacaaaattccatgcgtcacgccagccctctccgttcttcacgaagtaggccgccgcggcctcgttgtattgctggacgtaggagccgctgccgtcgcctttcggcttgtaaatgtcgggcccgtgatagccgggatcccacgccgaaaagaggagccggatcttgacgctgcgggcacttcggatcaggcggtcgtcgccctgaacgagctgcacgcagaccgacgggatcggtgcggcgatgttcggcggcgtcctgtcctttgagggaacgaaaagcgagaaggcggccgggttgaccagcttgtaggggtaggaggcgtctgtggccttatcgtccgggagcttcagcttgaccagagggcagacctcagcggtcagccagtcccggacggtttcgatgctgttgacgatggacatggcggcacctcctacatggtgacggtctggccgagggccacggtggcgatccccatgtcctcgctccagtcgttgacgatgtactcgcggccgtcgacgttgagcccttcgcccgccgggcgccgagcaggcagatcctcgaccgccgcgtaaagcagcagagaggactccgcgacgctcagctcttgccccccttggcgttccttcagggcgttgtcgtccagcacggcagcgatggcccggccttcgacggtgtgcttctcaccgaactcgtcgagattgagaaacgtgcgccggcggtcggcatcgaccatcgccttgaagctgaaggccatcagacaggatcggcggcgccgatctgagggggctcctcgtcgtcggtgccgtcatcgggctgctcggccttggcggcctcgatggcagcgatgacgtcggccttcttgcgcatggcagaggcgtccacgccatagcgcgcggccacttccttcagctcgtcgagcttcatgtcctcgtcgtactcaggggcctcgtcggccgcggtgttggtgctggcaggctcgtcggcgtcgtcgccgtgatcgggtgcgggctgctcggcaggctcgtcctgctcgccgatgtacttggcgacgccttccttcaccagacgggcctccagctcgtcgtcgaacttctgagggccgtctgcttcagtgatggggatcaccttgcggccgttatagtagccgaaggtgcccttgataatctggatcatgctctgctcctttctgctgcgttcagtccgtcaggacgtccgcaacgatgaacgggttcttgttgttggggatcatcagcgggcggctggagatggtcagcgtgcggctgttgccttcggcgctgctcacatacttcggcacgcggcggccggcgtaggtgtggaactcgccgtcgctctgctcgacctgagagacggcgccgtaggcggtgcggccagcgccgggagcggtgaggacgcacttgtcggacgggatgtagagcttgtcgttgccttcgtcgtcggtataggtcaggtcgtaggagatgacgctgatgatgcggccgaggacgttcaggcgggccacgatggcaacgccgtcaggcagcagctcgggctccgcgttgccaatctcgatgcggcggttgtcgaggagcttctgcacggccgcgtcgttgatgatggtgtcagccacgtccggggagcagaccagatcggaggcgcggaggccacgcttggtcagcatacggatcatagcctccagatccttcaggatcttgccgccggtggcgtcccacttggccgtcggggtgtaggttgcggggttgctggcctcggagtagaaacggatctccatctcgtcagccttgtcgacgtcgtcggcgatgtgcttcatcacacagccgttggtcagcatggtctcggcggccatcgcttcttcgcggttggtgatgagctcgcccagctcgtcagcgtcgcgcaggatgagggtctgctggcgctgctcaggggtgagctgagagtagagggcctcgccgaagccacgcttgcgcagctcgtcgagggtcaggacgcgacggggagccacgaagggcggggtgtagcgttccatattgtagccggcgcgcaggacggtgacgccgcccttgcgaggggccacgaagggcgccagcttcttgctgccgtcacggaactcgacgagcacgtcatcggtggcgaagatgtcgctcgcgtcgttggtggggaaatagcggtcacgcaggaaggtcgcggcaggggtgagctgctgcacggccatgagcagcgtgtgggtgtcgtagaagttaaaaggcattttgttgtcctccttctcttagtattcgatggcgtcggagagcaggatgccggccttgcgcagctcctcctcgtcggttgccttcagggtgtagccgcttgcgacggccagcttgttgcgggcgaagtggccggtgcggtaggccagcacggtcacgtccgcggtggtgccgacttccacgtcctcggcgaggatgcagttggcggtcagggtttcgttggtggtcgcggtggagccgaggatcaccagcttgccgtcgtcggcggtgccggcaggcagagccatcacggtgccgcgcttataggtggccgcggcggtggcctccttgcggatggtcacggtgagcacgtcagcgacgggctcgttggcaacgatcaggccgtcatagccgacgctgccgaggttttcgtccagtctcttgctcattacttcttacctccgttctgagacttggtggagttgtagaggccgacgatggcgtccacctttgccttgtcgtcgctttcgctgccttcttcgccgccgttaggggcagcgccgacgccggcagcgccggactcgtcgttgtcagccttggcgtccttcaggtgcttggcaccgagggccgcctgcttctgcatggccttgagcgcgagttgctcagcggtgcagggggtctcgccgtacttggcgtccctgacgagctgcgcgtcgcccacacttgcggcgatgctgtcgatggcctcgatgcgggcgcgctcctgcgttctggcagtttcggccgcctgctgctcgatctgagccacgacgtcggggtgctgtgctctcatttcttcgagggtcatggtcttgttgtcctccttcttggggccgtcgttcttggcggccgcgtgtttatttccagccgcaggggcggcgtggatgctgttgtcgatggggatcgtccccgggatgcgcctgaagcccttgacgtcgtgccggatgccggcgacgaggagcaccttcttgtcggcgctcagagtgacgtcggggccttcgtccgtgagcagggtgtcggcgaagccgttgtcgatggcctcctgcccgaccatccacgtctcgcgggtcatcatgctgcggagctggtcgacctcgatgccggtcttggcgtggtagatctccgcgatggcccgctcgctcgcgtcgaagtccttctggagcttcttcaggtctgcgagggtgtagtagtcgtagagcagcccggcgacgccgtggatcatcaccatgctgccgggatagacctgcacctcgtcgcctgcacaggcgatgacgctggccgcgctggctgcgatgccttccacgacgacgaccttgtggccggtcaggcccttgatggcgttgtggatggcgatgccggtgtagaggtcgccgccgcagctattgatcttgatggtgatgttgctcttgcccttgacggccgcgagatcctccatgaagctctcgggcgcgatgtagaggccgggctcgggctcgcccgtccaccagtccacaggctggcggctcacgacgtcgccgtagagggtgatctcgccctcgtcgtcgccggtgctggcgacgttccagaacttgatcggcgtgcccgcagtctgaggcccggcgcagagccggggagtgttatgcgttctcatgcttgtctccttccttgatgcttttgatggcctcggcgacgatcgcctcccgcagagctgcggagatcgtgccgctggccgctgtgctctggtcgacctgcccctgcgctgcgcgcagtttctcgttttcccgagcgagctggtcgacattggcgtcccactggccgccgttgagtcggatggtcgcctgctctctggtcgtgatgccttcgccgatggcgaggatctcggccgtgatctccttcgtcgggtcgagctgtccctgagaggggccgatccactcggcgccgaggtatgcggcgcggatcgtcgggtctgcgaagaagcccggggcgctgatgcggccgcgggcgacggcttcagagagccagatctcatagactggcgtgcagaagtcatcgacaaaccacttgcgcctcatgcggaacgccttccacgcctccatcagggcggcacggctggcgctgtacgagctgttgaagctcttgagcagcaggtcggccgggatctcgagcgcggcgcccacctgttcgcagatggcgcgcaggaaggtgttgaagccgctggccggccgctttgggtctgcaaaggtcacgtcctcgccgggctccatgatgttgatctggccggggcccatctcgtactcgttaggatctcggctcacctccggcaggctgctcccgacctcgttgaacgggttgtcgccggcgcctgcctcggtcttgatgaaggccgtgaaaaacgactcgacgaccgctgcggtcagctcgctctcggtgtagcggcgaagctggagcaggggctcgatgacctgcgcgagatagctgacgccgcggtattgatccggccgctcgctctccatgacgtgcaggatgttcggcaggccagtccgctcaccgtatgcctgaacgcgggcccacgttgtcgtcgtgctgccgagctcgaaggggtaggtgctgcggatgtggtacgcctcgatctggccgtcaccgttcacctcgacgccgtcgtagatggtgttgccgttggccgccttgccggtggtcagcagcatcggggtgatgatgccggaggtcgtcggtgtggcgactcggtcggcctcgatcaggtgaaggcgcagcgagtagggcgtgagcggcgtcggttcgtactgcttcacgacggcgaacacgtcgccgctgaccagccacgaggagagtgcgagctgctgcatggctgcgaagttgttgacgccggtggcgtcgcacgcccttttgttctcagaccagagggcgaactcccgctcggcctgagcctgccatgcgtccgcggcctcctgcgtcatgccgagcgcctcgcggtcgatccggctcttgagctggaggccgatgccgacgacgttggtgcggttggtgcggatggcagaggtggcgatcggggctgccatgtaaagcatccgggcacgctgccgcagggtgtagttgttggcgtcgatgtcctccttcgggctgccgctcatagctctgaagcccttggtcgccttcttgtgccagcttgcgccggcgtcgccgtagcccttattcacggggcgcggctgctgccgcctgttttgtgggcggcttctgctttttcttttgctgatggtgctcacctccttcatggtgaagatggccgggccgggagaaaaggagcgaaaactcccggcgtcggcctatgaaaaaagccccttttggggcttctttcaccagtctcggggcactactcccacagcttttcgcggcttctcgccgttcagtgcggcctcgagggcttcgatgtctgcctcgagctgtttgatggcggcccggatggatccgaggtcggtgttgtagcgggccagattgcgcgagccgatgccgtagctctggacgcctccgtccagcatctcggcctctcgcttcaggtagagctccagccggttcctcttgatggagagctggtactcgatttgttcgcgggtctttctcattgtggtgtgtcctccttaccagtcgtcgaaggcgtcggcccggttgtgccgtggccgctgccgtcgctgctgcggggccttcggcttttcctccagcccttgcaggcggcgctcgatggcgtccatgtcagggttgatgatcttgaggccggcgttggcatagtcgcggcagtcgagagcctcgttgcggttgtggccgggcagcttctcccacgcccagcggtcgccgcggcgtgtgtgcgtgagcaccagtttctcagagaggagcccgttgaagaaattgaggtcataaccggcgtcggggtgccggttgaaatggcaatatttcggcccggcctcctgcaccttcagattagccatgatcgtcgccttgccggcgtcgacgccgatggtgtagagccagcaggtgatccgcttgttgtcgcggatcggcaccttgctcggaggcgagacgaaggggatgccgtcgccgcccttgcccttgatggcaaagacgcgcttgccgacgcgggcccggcacgcctcatagacctcttgggtgaagtggccgccggagtcgacgcaggtgatggagatcttcagaccgcggccgtttttgaacttgtagacgtggtcgaccacgtcgtcgagccgctgccagacctccggagtgtccggccggcccatgatgtagcccttgacgatgccccacgtctcgccatacttcccgtgaccgactacttcgtattcgaggcggttgtcctgagtgtcgacgccgcaggtcagcacgagcacgccgtcaggcagctccacaggggtgccgtccgagcgggtgccgtagtcctcgcggcgggagagcatggtgtcctcgtcctcgaggtcgccgcgatcttcccacagttggccgagcagggtgttgtagacgaccttgaggcgctgcgggtcatccttggcgtcgaggaacttgaggacgatcttctcccacggagtccacgggctcgagaaggcattgagccaaaaagaacggacgccctttttgtaggcgtccgggttgtctgcgatccacttggccggctgctttcgcatgacgtcctcggggatcaggcagccgcaggccgggcagctccacgagacaccgctcttgaggctccacgactttttcccgcggatcctcttgacctccgggtcgaaatggatgttgtcgaacacgatctcgctgtactccccgcactcggggcagtggtggcaccagcgttcctgcgtgccttggtaaaaactcgtctcgatgttgctgttgcccttgatggtcggggtggagacctcgaccgccttcgcattgtagaatgtggcctgacgtgcttcggccagcgcccacgggtcgccctcggtgccggcgctggtcgcccagcggtcgcgctcgtcgccgatgatgtagcgggcgggcgtggaggccagagccgaggcgctgttggagccggtcagggtgagcataccgcccgggaaagacttctggaggatcgtgttgccgctgtccttggccttgacgtcgtgcaccttcgccttcaggggcttgctgtcgcggatcatgggggccacgcggaggcggctgaactttcgggcgtcgtcgatggtcgggtggacgtagaggatgctgccggggtcttggtcgatgatgtagccgatgatgttgagctcgagctcggacttgccgacctgagaagcggctaccatgactattttgtgcaccttcggatccgtaaaggcccgcatgggctcctcgaggtacggggtgcgcttggtgcgccacgggccggcctcggctgagctttccggggagaggcggcggtgcttgtcggcccactcgtccacggtcagactctcaggcggggcgaagcgtttgaccgctccggcgatggcggtattgagcttcgcggcggcttttttagtcgtccgcgtcatcggcgagctgttcgccccagccttcccgatcccttactcgccgggcgtacacctcgggatcgtatttatagccggccagctccgtcaggatcttgtagacctctgtgcggatgatctcggacgcctcggcgggtgttgctgcgccggtgacgtcgacggccagacggcccggcagggccacgagcatcgacctgatattgtagacgaggtcggtcatcacagcctcgacgtcctcgctgcggtgcatggtgccctcgagctcgctgagctggagggcggcgatgtctgccttgctgcgcttgaggtcagcctcagcctccagacgccggccctcgatctcgctgtccttcttcgacggctcccggccgttggccttggccgtcaggtatcggatgtacctctggatcgtcggcagcaggtcgtagcggttggcgttgccttccttgaccgcggtgatgacgccctccttggtgagctgctgcactcggcggggcgtcatgtcgaacagggccgcgatggtcttactgtcgacgagcttgttgttggtttggttcggcatggcgttccctcctttctgccgctcgggcgaaacgaaacggcccgaaaaaaattttccccggctgcgcgttttttgggctcgccagcaccgcaggccagagaggcccgtcacagtaccttgcggcgctgcgcgtggccgtggaggcgtctgcgcggcgctgtggcgcgctctgtgcgcgtctggcggtgtggggccgggctcggtgcagggcgccgtggtgggcgccctgcgggccgctgtgggctacttcccgagagctcggtcgaggttgtgctggaggcgcttggccgtctcctcttggagtcgggtcattatcttctcattggtgcgctcgcttgttatcatggagggcaccgagatggtggtgaacttcttgatgtcggtgcgcgtccggctcattcgctggaatggaatggcgctgacgccgccggccttggtgttgcccgtccccatgaggatgttgtgcgatcgctcggagtacgggccgcccggggtgcgggtgttcaggtaacggccgatgaccttcttctgccccttgaccacctgcatccgcagcgtgtagctcttgcccggcggtgcggtctttggtgtcatgccgaagtgcacaggggtgagcatccggccggagtaggtgatggtcagctcctcgatggtctctcccgagacgttgacgctgcccgccatcttcttcggcttgctgctgttcttgccggacggggtgatctcgcccttcttgatgttgtagaccgatgtgacttcctgagcgatccagctcggcgctctggccttgacgtcgcggacggtggccttcacggccttgcggccctgctcgtcgatctgcgcgacagtgtccatgagcttttggaagttttcgacctgcatggtgatagttgcctttgccgttattgtcacctcctgaatatgcaaaaagagaccggcgggcgttggttcgcccgtcggcctcttgccgtcggttgttattcggttttcctctggtcagccgctcggaattgtcacggcgttgcccgtgtgtccggcggtcttttgcaggatataggatagcacgggtcgctactgcttttcaattccttttacttcccttttgttccttttactgcgttttactgccgcagctcaggcaggggctccaactcgtccagtacggcggcgaggttgagcagggcgcggccgtggatcttgtatgtcctgttctggtaggcgtccactctgtcgatgtagtcccgccgatcaccgaacaggacgccgcaggtgctctcccagtcggcccggtcgaagtagcgcagccggatgacggcgcgctcgtcggggtcggagagctggaggatcaggccctcgatggcgttgcgctcctgcttctcctcagccttgagccggtcgatctgttcctcgagctccattttccgctccaccatcatgccggtgcggtcggatggtgtgccggatccgcggggcatacctgtcaggtcagggccgggcggggaggccatcgtcatctccatgcggtcgaggcgctcgagttggttgtcgatgtccctcagcatggcggtgtaggccgcgagcctgtccttgatccgttgtgtgatcggcttctcgctcattatgtcagggcgtcactcctgctcacctccttcctcgtcaggctcgaagatcgcggcgatctcctcgcgcggtagctctcggccttgacggacgcagcgcacggttgtctttcctgttattctgatgtacctcttgacgatcacgtccgtgaaggcgggcgtcagctccatgatgtaggagggctgcccgtatgcctcgcaggcggccagcgttgtgccggagccgccgaagggatcatagacgcccgtggcgaagtccgtgttgtcgaccagcttctccagcagctcgacgggcttctgcgtggggtgcagctcattcccggagcgggagatgctcaggacgttgccgtagcccttgtgaccgtcgaagtgcgtggcagccttggcgccgaacagaatgagctcatgttgcgagcgccagccgacgcccatgcccggcgtgcccttgtcccatacgatctcagacttgacgccgaagccggccgcctcgacgaggtcgaacagatatacccacatacgccagtcggtgaagatgtaggcgtagaggcaggggatgtcggtgagcgcgccgcggatcaggttttggtagccgcgcgtgctgaggatgtcgttggcgatcttcggggccttgccgttctttcgctcggtgccgatgctgccggtcgacttctgtgactccttgctgccgcccgagcagtagggcgggtcggtcagcaggatctcgggcttgttgccgtcgagcagtagggcgcgatcctccggccgggtgcagtctccgcagaggacgcggtgccggccgaggatccagaggtcgccgtactgcgtgaccggcgcggccggggtcgggatctcggcgtcggggtcgtcgctcggctccttggtgtgcagcgcctcagagagggccgtcacgatgttgccgtagtcgtcctcggtgtagccgctgagcatgaacgggatctcgccggtgtcgatgtcggcgaaaacctcggcgagcatcttgttgtcggtggtggcgagctccgcgatgcggttgtcggccgtcaggtcggccagctcctcggcctcgctggcgtagtcctgatagtcgaccggggcgtcggtcagatcgtcgagctgcgcggccatgaggcggccgtggccctttgtgacgagcccgctgcgcttgctgacggtgatcggagcgcgccagccggtcgcccggatgatagaagcgaggagcttgatctgctccggcgggtgttggttggggttcttggggttaggccgcagatccttcagcgggacgatggcgtcgtgtgcgcagaacacggggacgctgccggcgtatgccttcggcgtggccgtggtgctgtattcctcgatctcggggccggtctgcggctgcggtttgtcttttgccatgtggttcctcctttcagccgcggtgagatacctccgctgctgtggctgcgtcgaggcgcttcttcaggcgctccagcttgtactcctcagcctcggccgtgctgcggccgaagatgatgcggagctggtcgagcatgatctggacgtctgccatctcctcgaccgcgttctcgagtacagccttcgcctctgcggcgcagctcacgcgcttcaccttgcagagggctttggtcagctcggccatctcctcgacggccatgtccatttgtgccggcgcgccgtaggtcgtgatcgcacgatccagcagggcccggcgctcctccgtggtcatcacgggcggcctcccttcgtcagctctctgaccagtacggccacgagcacgatcacgatgatggcgatggtgatggcggtcgggatccagatgggggccagtacccacagccagctccagttgatgacgccggtgagcttcaggacgatgaaggcggcggcgagaaggccgcagaagccgatcccgccggccgtcgtgttgtttctttcgttgttcatgtattacctccagtattatttgccgagccccttcagcgcgcaggctgtgcaggcggttcggacgtcgggctccagtgcaaggatccggcgggccgtgtctgtctgccagcactcagcgccgcagacagggcaggtggtgagctgccagtcgtccgtcggaggctccgggacattgtcatgcagcggcatggtgaggatcccgccgtctccgggctggcggggcgagaggatgggctcaggctcgtcggggatcatagcctcgaggagctcgttgtacttcttgaatatggcctccgacgctgcgctccagctctcgccgtgctccgtgtcctccggggtggcgacatgggccagctcgtgcgccagcagctcaggggcggcgctgatgggcgcctcggccgagatgcagacgatcggcgtgccgccgtcgtcggggaagatggtcagaccgtaggcggtgccgttggtttcgtcccgcaggtcggggacgtactgcgcgacgtactcgatgccggggtagagctcggagaaggcccgggccacgatggccgtcgggtcattgatgaagggcgaggccatcgggccgatcttctcgtactgcttcagggctgcgtaggtctcacgcagcatggcccgcacttcgtccttcttgatgccgttgatggtgggcccgttcaggatcaggtcgagcatcctgtcgctccagtcctgcatcaggtgggtctccggcataccgcagccgaagggcacgacgtcgaccttctcacgggtgagggtttcgtattctttcacggtgctgctcctttcagaaaagccgagcgggccggagcccgcccggcgctccatttactgcatgacgacgaccttgccggcgtcgatcagatcgcccatgttcttcaggaagtagtcggcgatgttcttcttcgcctcgagtttccagatgccgccgtcagcctcgaagaagccgatcccctcgtcgggatccacgcgcagcaggaactcgctctcgggctgctccacctcgaggaaggtgcggaacggccgcagcatgacgcggggcttgatctcgacgagcgcgttgagggcgacgccctgacgtgcctcgacggtctgcgtgacgccgttgtcgttggtgctgacgctgttctcgttggtcatgcgactcagcaggtcgagcaggtaggccgtgccctcgttagggatgcagaggctccgcagctcgatcagggctacctcgcgtcctctgaagccggtgcgcaggcccggggcgtcagccttggcgcggtagagcgtgttgcgggagaagtcgctcaggtaggtggtcatcacctcgacggtgtcgttgctcttgacctgcaccatgatggtcgtgccgaccttctcgagctcggtgcggatcagcttgcagatgctatcgaggccgctgacgctgatgcagtcggggcggtcgacgtggggcgggatgcgggtgagggatgcgtcggcgtaggtctggccgtcgatctcgaagatcttggtctccttcaggctgacgattttgtcgatcatttttgcgagcattgtgttgtcctccttgttctgtgttgtgggtggttatgcgtgctggacgagcttcaggagcttcggggcctcctgctgcgtgccgtccatgttcatttggccgggcacctgcggcaccatctcggcgacgacgagctcgccgtttccgtcagaggtgacatagagggccgtggcgacggggttggtggctgcgagcgtagacttggccgtcacggagacgccgatggtgcggcgttcgtcgtccggggtcagctcgatggtgagggtgatcttgcgcttggccgtggccttcgtgttggggtcgaggatgttctggatcaccttgtccatctcatagtcgacgcgctcctcgaaggcgccgcgggccatcgacatgatgctgtcgcgctggttctgttcgttcatggggtttctcctttctctcaggtggccgatccgagcgtcatctgctcggcctcggtcgggttgtctgcgtaggttgcgaccgtctggcccgtggggcccgaaggctccgctctggcccatacggcctcggtggcgtccgagcgggtggccttgcggcggccgaccgtcgtgaggatcccgatctccttcagctccgtgagccgcggggcgacatagttgcggttgaagtacgggatccggccggttgcgacgagctcctcggtgatctcgctggccgtgagctcacggtcgccgagggtctcgaggatcaggcggcagcgggcggcccgcttggggagtacggcgtcatagctgcggtgccgggtctctttggttgtctggttcatgtgtttcctcctttccggccagctcgacgctgtcggctggcacgctgttggtgcatacttgcccgggctatgcgacgtccgtttttacggcggtttcagcctgtgggaggagtttgaagatctccgcgatgaccgaagccgtccatccgtttccgattgctctctttctcgccggttccgggacggctgctgtgtagccggcggggagcccttggagcttttcgagctcctcgacggtaaagtgccggatgacattgtcgtaaaatacgcagatgtcgcaagcgcaggtgatggtatggcttttctgatgtatcacgcggccgcgtctggtggcgctcccggggaaggcgagggagacgccgtcgccatcgacggcctcgatatatccgcaggccgtggcctgcttgaccacgatgccgccggcggtcttttggacgagccccattgagtcctcagatattcccgggccgaacaggagcccgccggcctccgtgaagccgctcacgtcgacgctgcggtcgatgatggtgtccaacggctgccccccccgctactcagcgggctgaggtctgcgatgttgctccagtaggccctcggccgattttgagcggagtgcgcgcggctgttgatgtggacgggctgcacgccgagtttctcagtgatgacgtcctcccactcgcgtttcataatcacattttcgaggaggaacttcacgtcgggttttttctccctgacttcgttcaggactcgcacatagtcaaaaaacaggcggctgcgcggatcgtcgaagtttaggccggccccagccctcgagaagccttgacaggggctcccgccgatgacgaggtcaatcttcgggaggtctggcgccgtcacgctttccacggggccgatgtggatcatgtcgggccagtttgccctcgccacggccttcgcgtccttgtcgatctcgctggcgatgtaaaggtcgacgggcacgccagccatctccagcgcgaggcggccggtcgctattccgtcgaaaaggctcaggactctcatactgtcacctcctcgatgccgtgcaggaacttgatgaaaccggccgtcgccggcacctcgtagcgggagagctctgcgtgcgtcatgtacttgcggccgtagatttcagccatatcacgccagacgggccacggcacgcggtagaagtccgtcaggctcacggagacgagcacgaaggcgacggcgccgagcttgtgatgggcctcgaggtcgtcctgctgctcttgggtgagccggcgctgctcgatgcgctcgtcgtcggtttgcttggcctcgaagtagatgctccggccgcccttcagggtgccgccatagtccggctgggcctgcttggtgtagcaggcgaggaactggcccttgcggttcttggcaccgaggggcttcatgggctccggcgtcttttcgatcttggcgaggccgcggctgaggtagtagtcgcacgaggccgagatgatattctcgaagtagccgccggcgactctggcctgcttgccgcggatctgcgccatcatgtgtttttcggctgcgtagggcgtcgggtcgttgtagccctccgcgttctttctcgggtcgtacttcgtcacggcgttcagcctccaatctcgatgtggacgcccggatcggagatcaggcggtcggcgagctcgaggatggcgctgccgtccagcttgatgctgagagggccgtggtcgaggtgctggttgcagacagccatcgccttgaaggcgggcaggtgcaacgtgacgctgccgatgtcaggctcgtcctcctcggtgttttcgggctcctcgtcaggcttcagctcactgatggcctcgaagccgttacggacggggatgccgtgcgccttggcgagctcgatctccgcagccatgtcggccgaagggtggtcgatgccgaaggcccacagctcggagcagccgagcaccagctcgctgccgatcttcagggccagctcacgctcctcggggacgttgtcgtccatgaactgcgtgagatagatgtgcggggtgacggggatgacgcccttctccacagccgcgcggctgtactccttggcgcgctggatgttgttctcgtagtccccgcggcacggggagcagatgtaaacctttttcatgtcgttcctcctatcgtgagcgccagctctggccggtgagggtgatgcccctgcacatttccatgagccggtcgatggtggcccgggctgtcatgctgtcgcggctttctcgcggcgtcatgcggtcgatcagggcctcggtgtcgtagttggtggtcactatggtcggcaggtatgcctcatagcggccgttgatgatgttgtagaccgtggagatcgcccactctgtcggcggctccttgccgatgtcgtcgatcacgaggagcgggacggtcttgtagatcttcaggacgtcgctctcgctgccgccggtcgcggagtaggtgcgcttgatacgctccagcaggtcgatcatcgtcatgcagatgaccggcttgccctgcgcgatcaggtggttggcgatggcagcggcgaggtgggtcttgccggtgcccggcgggccagcgataaacaggccgttgcggccgggctcctgacggccgggctgcggcagcatggcgtcgaagccttcggcgtagcgccgggcggctgccgctgcgcgcttgttgtcgtcggtgagctggaaggtggagaaggtgcgccgcaggaaacggtcgcccatgccggactcgccgacgatgcgcttgatgcgttcccgcattttcttctcctcctcggccttggcggctgcggcctcggcagcttcgcgctctgccttctccttctcgtaggcagccacggcctcggggcaggtgcatcgctcggctccgtaggggggccagaggatgcggtcgccgagcgggatgcccttgtggtagcgcagggcgccgcagaactcgcaggggacgggctcagggactccggggcggccagcgaggcgctcgtcgttgctccagatccagttgccggggtcactcgtcgtcggccggtttgaagcccttgccccagtctcggccggagctgtcgggctgctcaggatctcgctgattttctgcaccttcgttcacctcctcgttatcccagtagccgccgttgagccatgtgctcgggtttggtatgtagcgcccgttctcccggcgccactggtcgctccgcttctgagcgtcgaccgcctgcatgatcctctcgtggagctcagcggtgggcttgatcttgttccacgccttcagagcgtactgcttgccggtctttttcgggtaggctttccagaactcgagaaatctggcctcaacgagcgacttcgtgccgtcgtcactcccctcgtcagagggggaagggggtgtattaccttctcttgtcttatcttctctactctggtctactctgcctccggctttcttgcggccgtttgccggtcgtccggcggtcggcgtcgggtcgtccggcgaggcgtcggcagacgccgcagcagcggcccggcggctgcgggaacgctctttctcggcttgccgctggtcgatcagcttgccggcgtactcgtaccagtcgtggatctcgagcgtcccgtcctctttttcgtcgatccagcccgcccggatcagtgttttcgccagtttttcggggtctccgtcccactgagcggcccgcgagatcatgcgcggcgtgatgtccgagaggctgccggtcggggcgttgtcgagggcccacagccagaacgagacgagcagccccatcatgtgcggcggctcgacttcgagctggtcagcagcgtcgaacagtttgcggtgatccttgagtgtctgatgcacttgcagccatgccacggtcgtcacctcctttctgtggtcgttggtttgtggcccgtttttggtcgtctgccggtcgtccggcggtcaggttaaaagggaaggtcgccatcgccctcgatctccgtgaagtcgctggagccctcagagtagcccggatcagcgaagtcgctgccggagctctggctgccgtccttcttgctgtcgcagaagtggacggagtcgaccgtgatctcgacggccttgcggcggttgccgtccttgtcctcgtagctgcggctcgtgagctcgccctcgacgaggacgaggcggcccttgctcagatatttgcagacgaactcggcctgcgcgcgccatgcgacgcactcgatgaagttggtgatcttcttgccgtccttggtcttgcggccggtgtcgctggcgagggtgaagctggtgatcgccgtgccctgctgcgtgtatctgagctcagggtcggcggttagacggccttggaggccggtgtggttatacattaggcatttcctccttgctggttatgctgcgcggctgcgttgtcgagggacgtgcagatctcgtcgtactcttggcgggtcagggtggccggatcctgctttttgtacttctccacgatccgggcgttggtgcgctccttggtcattcctgcggcctctgccttcttgtagagacgtgcgagctgcgcgtcgctcaggcggccggagctctgcccctgacggccctgtgcggcctgctggcggcctccagcgccggatcctttgccctgtgcgccgaagtcactgttgtcggggtcgtcctcgccttggtcgacggtgaacttctcgaaaaggtagtatttcagggcgtaggtgtgggccgcgcccttggccttggccgggtcatcgttccagccgacggcgtggacggtggcctcgatggtctcgtcgtcgttgtcgaggttcagccagcggatcgtcaggtcggcctcgtagaggaacatgagcttgtcgccgttgcgggtcttggtctgcatggtgatccagtagaccgggtcgccgttctcggcgtggcgggtggcctgctcgctgatgacgtcgaagtcgacgccgagctcgttcattatgggggtgatcttctcccacacgtcgtagatcttggcgtacttgtagctgacgccgtcgctgtgctgcttcttgacgatctccgggcaggctttccgcatttcgacgagcttctgccggagcgtcaggcaggcggcttcaggaggggccgcagcagcggccgcctcggttttcttggtttctgccatgtcggtgcctccttacacgtcgaccgtgaagatgccctgggtctcgtagacggtgacgccctccacgatctcgccggtctcggtcagggttgcgatgtcgccggtgtagctgagcagcttcttcaggtcggcccagcgggtcgactcctcgaccttcacgagctcgccgtagccgttggccttgagccacggcaccagcttggcctcgtcgagtttggtcttggtggtgcccttcttgaaggtcagggtgccggagaggaggcggtacttctccgtcgtcttggtctccttgtgggggacggtggcgaagaagtcggccagacagctcgtcaggtacgaggtgccgttctccatgcgcttgcgggcggcggcgactttctcgttgatggccgcgatctgctcgtcggccagagccttcaggcggtcgtactcgctgcgctcgtcggcgatcttgcggatggcccagtcggcacagcggtcgtcagtgatgcggaacggggcgcgctcgccctctgcgacggtgccgagatcgacctgctccagctcgtccagcgtggcagcgggcagcagctcgggctcctgcgtggtggtggcttcgacgtctgcctgctcggcagcgagggccgcggtggtcttatcgctcattgttgtgctcctttctctcggtgacgttgaaggtgagcatcacgccgcaggtgacaggggtgacgctctcgagctcgaggtcgcggccgctgcggaggtgcagggtctcgcccggcttcatttcggtgaggtgtttcatctggtactcctttctgcaaagaaacggtgcccgccttcctcgatgacgaagatctggctctcgtggaagtcgctggtcacgagggcggggttgtagaagtagaggatcggctcgtccacgacggtctcacctcggtcgaacacggccgcgacggcgtccttgacgcgctgtgtgggatccggccggctcttggtgtagctgtaaaggacgacggcctcagagggctcgacgccgcgcttctcggctgcgttgaggatgcactgagcgacgagcatctggccctcgaaggactccccgccggcctcggccatgaccacgcgctcgacgacgtcgcgctcggcgtcggtcagagagtagcgcaggacaggctcagccggttcggctggctccgcagcctcagaggccggggctgtggcgtccgggatgtatgcgccgacggtgttggtcggcggcaggagatcggtctcctgcttgctgccggccggggtggtgaagattgccacggagatgccgcccagcagaaggacggcggcggccagcgtggccgctctcagggctttcctcttggcacggcggcgccggcgtgttatacttgcggtgcgggatccgtatgctggcaggctgctggatcttctcgcatgggtcgcccggtcgcaacgggcggccctttctcttgtggtttccattggtttctcctttcactgagcccgtgcgacggtcagaccacagagggcatgagtgaggtcgctgaactcggtctctcggacggtgtcagcggtcagcagcacgaggtagtcgttgtcgtagtagtcgatctcgggatgccgctgccggtttacttcgtttttgtggcgggcgtagggctcggcacggttccagacgtcgtcagggatccagcggtcgaggtgatcctcgacgcgctcgcgcagctcctcgctcgtgattgtgatctccgggctcatgctgtcacctcctgagtgcgcctatcgcgtactcgagcgcgatgatgtcgcagttgtagcgcaggttttcctcgtcgatgatgtgcagtttcttccgctcggcgagaagctcagcgagctggtcgaccacgtcgaagccttcagggagcgtggcgggtgccggggcgtctctctctttcagtgctcggtcgttttcgatgatctgctccttgatttccttgggggcgtccgagaggtctgtcgtctggttggtactttcgggcatttcagcctcctgctctgtggtgtgctcgaagcgtttgccgagctcccagtcgtcgcggcgaaggtcgaaggcgtcaccgagctgaatgatgtcggggtagttgctgagcgcgacggtcatggcgggcttgtcgatttcgtaggcgtagtaggttacattcgtaaagcccattttatcgaggcaatagcgcccggtgccgatgccgtcgtacatgaagaggacgacgatctcctcgtccctcggcacgtccttcagggctcccgtgaggatgtgaatgatgacctcagccgtccagccattcccgagcccgcggtatctttgcgtcgcgctgactgccgatgtatagccatcagggagagtctgaaggcgctcgcactccgtaggcgtgagctttcggatgacgtagtagccgtccggcagtttgatcgggtactttttccctttgatctcgatttctccgttgaccacctcatagactggcagatcttcgccgttttggttggtgacgacgagcctactctgatgtcccgacgccgtgagggcgttggctttaccgtcggttcttacctcgtatgcagagccatcgtctcggccgcgccatgcggcgccctgagcctctcctgcggggtaggcgtaaagcccggtctcagggccgcctccgttgggtctggcgcatagtgccacagctttgccgctcgcgtcgtagatcctgtgggcttgtcctccagtgatctctccgtccgcgtttggcatggtgccgactcttactggtgcggcgtaaagtcctgtttttgcaccgagcccgccgccttcgccgcacagggtcgttgctttcccttcgggggaatagactctgtactgcttggagtcgtggctctgtttcttggcgttgttctcgatggtgccgatcctgatgggctcggcaaccatgctgtcggtctgtactgttgtcagggcgttggctttggggacgccgctggtctcgaagcgtcggtacagctttccgtcgtcctcgcgcctgttcctgcatccgactccgaccgctggagccctgagctcgtaccccttttcggaggtggtcgtctcgaggatgtccttcagcatgatgccgcgatccgcaggctggtcgatgttccagttgaaggcataaaagcgttgacggttctgtgcgcttacgagggcgctgttgatgtgcatgagctccacgccgagctcgtggctgatttggtctttaatgggctgtgcggcgctcttgttgttctcatagaggaaaaagtcgggcttgaatttttcctttgcaatcaggtagtttctgaacaactcccagccgagcccctcagcttctacctctcgccctttcttctgcgcgacgctccagtaggtgcacggagagccgccgatcaaaatctttatcatccatttcacttccttcctgtgcgggccgggagcgtctgctccgggcgggtcaggcccttgctgaagctctgcggctcatacctgacgcccacgatccggcggccgctgacgccgtacttggggttgtagccgaacaggttgacgtagctgccgagatcctcgcgctcgtcgtccatcgccttcagcacctcgaacagggccagcacgtcgtcgatggcgcggtggctgttttgcaccttgccggtgaggtcgtaggcgatgatcgcgttggcgagcttgtgcgggtaggccctgcggtctttgtagaccgtcaggctgtccagccagtcgatccggccgactttctggccgcggagcaggccacggagaaaacaggcgtcaaactgcgcattgtgggcgatcatcagggtcgggccgttctgcatgagcttggcgatctggctggccgccttggccggctgcacgccctcggtctgaagccgctcgtcggtgatgccggtcaggctgacgatgttctccgggagggtctcgccctcgggcagcttgatgaaggtgtccatcttgccggcgatccgcaggccgccggtggccgtgcgctccacgcgcagggcggcgagctcgatgatctggtcgttgtcgaagtcgagaccgctggtctcggtgtcaaacacgacgagggccttgtagcggtcgaacagggtggagaggttactcatgccgggcctccttctcgcgggtagctctcagcgtgccgagcataaacgagagggccgtggtcagttgatcctcggtggcgaaggtgccgccgaactgctcggccagcgccgcgatgatctcgccggcgtgctccggcgtgacgtcgtcggtggcttcgtcgtcctcgacggagatcaggagatcggagtccagataacaagcggggcgcaggccgccgaggccgcggcaggcgctgtccccgaccagagtgccatcggtgaagacgcggcgggcgagtgactcgtagccgttagacttcgtgctgaaggcggtggacagccaccaccagtcgtctgcgttggggatgacgtcgcggttgcgccggtactggtcgaccgtcagcaggaagatggtgacggtgcaggtgccgtagtctttcaggccgtcgtcggtggtcaggtcgagctcgctctcgaggaaggcgttggcgccgttgcaggcgtcgaccagattgtcgaggtaggggccgttcaggtacttgttgctgctggcgacggcgaagttgttgcagttgccctcgtcgaaggcgcgggtctcggtgatgtccttgctcaggcagagcgtccggctggtgtggtcattctccagcaggatccagctctggccggcatagtcgaaggccgtgccgcgggcggcgttcttgagtgcgatctttttcatggggttgctcctttcgttctctgcggccgagccttctggctggcctgaatgttcggcagggtctcgccggcgcggagccggctctcacagtgcgggcagatgtagccggtgcgggggatcttctggtagatgctgacgttccagtcgagcccgcagccgacgcacttggctgtcatgggcctccacctccttccgcagccagagcctcgaaaacatagcgccggatgcggttgcggtacttcttccgggttctggctttctttgcgtgagccgcgaggtgcagccacttcggcggcactccgatggccttggccgataccttccagagctttttgagggcagagagcacggcgttgatgaccggcttcagggcctcggccagtttggcggcgatttcccgcagagcgtcggccagcttctcgaaggcttcgcgggcctgctgcatcttctcacgatcggcgagcgccatgctgccgtcgtagacgtaggggctcagctcgtcgtcgcctccgtcggccagacgctcacaaaacgggaggccggcagcttcggcagccttgcggccctcctcgagggcgtcccggccttgcgtgacttcgcaatagtccgcgagacggttgcagccgccttcgtagtgccagcggatcccggcggcgatctcgtcgatggtcatgtcctcgccgaagtggccgcagtagtagccgttgacgatgacggcgtccgggtctgccttcaggatcccgatggcgtcattgaggtcgtcagtctcccacgcgccgttccagatgtcgctccagatcgtcagagcgttccacgagcggccggtgcggtacactattgtccagccgatgccgtcgcggatctccgcggcgaagtcccgggcgatgtctctcagtgctgccatgctgttgcctcctctctggtgatgtgcacgacggtgacgaggtcgtcgatctcgtgcttggtggtgtatgtgtcccgctcgtcgagcccgatgtgccgtagcagcgtctcgggcccatccagcaggaaggcggtgacggccacggcgttcagccggtagaccgtgacctccacggtgcagcgggcgtcgtcctcatccagcgtggacgggaacgaggcccggcagattggggtcgcctcgtatctgaaggcggtcgcgcggttctcgccggcgatgatgtccttcacgaactcctcgaaggctttgcgagggatcgagctgcggtacttgtccagcgtgacgtcggcgagctgccggatggctttggtgttcatgttccgcacctcctcagcaggcgtcgccgtgcgggccgacggtcatgatgctcttggtagctccgttcttgtcgatccagatctcctcgacgctgttgtcggcccagtagatcgtctgatgaagtttccactcgcgggcgtcgtccgctgccttctcggcttctcgagccgcctgctggagctccttcagcctgttgaactccttcacggtcaggctgcgtcccggctcgctcagggcgtagtcgctgaggtagtaggtggcaaaggtctgatgccacccggcgttgtaccagcggctcgtcaccttttcggcgaaggccagcaaatcggcgtcgttttcgatagggccgaagcctcggacggtgaagatgaactcgtctcggctgtacgtcggttttccgttgacatagccgtacacgtttggatcgtatttcatggtgtgctcctttctacttggcccggggttcccggggatcttggcgtttttagcagcaggcgaagatcgcggcgatctgcgccttggtcgctctctggtagctggaataaaaaacacgaccgccgacttcttggttgatggcatagtggccgtcggcgtagcgcttaatgagccacactttgcgagggttccacttgtcaaccttgcgtgtcagggtcgtgttgtttcttctgcttctcatgggggtctcctttcttcggcccggcgctgccgggtgttcttggctactgtgcggccggtgctcgtttacctctgcgtttgaagctctcacgcagccgcctctcggcgagctctgcgctgtacccttcgcgctggttggcgtccagcgcgccggtcgcgcctcgctggagctccttgtagattgtggtgtggtggacgctcaggcgggccgcaatatcgaccggccgatctccgagcagatgccacgcctcgatcttcttcctgtcctcgaaggtcaggtagcggtactttcccgtcagtctcacctccgtcctatggggttgtagtaaagaaaaaacgcacagccgactcagttgagtctctgtgcgtttaatgataatggacagccttttgtgttaaaggtctgtatttttcttgactttaacacaataagcgttgataattgtgttaaaggtcagaatccagaaaaagcaatggtcccggcctttgaaaataacgcaagccgcccggacgctgggcggcagaacggaggattccacatgaaaaaggttctatctcttgtccttgcggcggtgcttgccgcatccctctccgcctgcggcggcgctcttgtcgatctggacacgcccaaatcggaggaactgacggcgcagtatgatttttaccccgatgccatgaacagcattcgggcggatatgaaaatcactcccgaacaggccgatgaagtctttatcattctgacttcctgcggccttgatgggaagattacaagcatttccgaaagcaagggcgtgtataccgtctattacggcggttcatccctcgacgttgcactttctgacggtgcggttgaagccgtctattccgggcgtgatatgctgtaccccgaatatcacaagcacaatgtcttgatggactatgacttgaccgtaaaggacgtaaaaactggttccggcgacaaaatcggtgaatacgcctatatccgcattacgaaagcacagcttcaatccattacggaagaaaactacaaagaattcgttgaaaccgtcgtcaaggacagcggctacaactgggttgcaattctttgtgatgacggcacgggtatttgtttccccggttctatgtactatgttggtacatacgggaagcaagataccgacggttctattcttgaagattacggcgctatcacgctggacgaaaacggcggctatacatacgaacagttctgaacagcaggaaagcaaaagcgacgggcgcaacgcccgccgctttctttatgccttttcctgctccgcgtctgccgcggcctgaacctctgccgcgaactgctccggcgacagtcccaacaccaccgccgcccgttcgtccatcagcgattcgatcatgtcgtttatgctgtcaaacccgcttgcctttgccgctctctgatatacggacttcttgcctttctttacatacgggtaaatcctgtcatagtttttgctgttgtatttccgcttcgcgtctgttgcggctttcccgcgtgggtttccatatttgcttgccattgtcaccactcctttacttgtccattttatcacgctgtttatactaacgcaagtataaaaaacatacaatctatcgttagtatatttgtgcatcattccagcttgtatttatactaacgttagtatataatcataatcagaaagggaaaccaaagccgcccggttgtcggggcgtagagttcgacaacagccaaccttacgggctgacacgaaaagggaaccgacacggcatacaacaacacttcaacttctggtttttatatgggggtaatcaatatgaaaaagttcgagatcggcaaggaatattttgaccgtagcgcctgcaatcacgattgcattttcaccatcaagattatcaagcgcaccgaaaagacggtgacgttcgagcgtaacggcaagacccgccgcgcaaagctgttcttcgatgaacacggcgaatatatcattcccgaacgttattctatggccccggtcttccgtgctgaaaacgaggttcagccggaagagggacccagcgtcgaggaagccgccgaaacgtcctgcggcgttgaaatcgcccagcccgccgacgtgaacaccgttgttgttatggtgggtcagcgcgtcgaacgtgtctgcggtgcttgctatcctccgcagggcggaaccgtcatcggctttgttagcctacctgatacccgtttctttcatggcggcgttttcgccatggtcttgtatgacggcgcaaaggctcctgaacgtgtccgcctgtccgacattcaccgccgcgggtggcgctctcccggcggttctccgttgggtgtgttcgtcgcctgacgctttaccggggcggcggtttccgccgctccgcttttcgcgccgctgtatctaccgcaacggcgcaaaatttttctgctttttcgcattttccctattgactttatactaacgttagtatataataagagcataaagaaagggggtgacaaggtgaagaagaaaaagaaaaagcccacgaaatcgcgggtcgatgttcggaccatcgtgataaccgcaatcgtggactttctggtagggcttgcgttactgataattgataaactgacgtaagccgaaaccccgtattctatgggcgggttcaccgcccacccatagaatacactttttcttctgaactgtcaaccatgcttgaaaaactcggaatcttcctgatcgctgttgccgttgtgaagctgattatcgccgccgcggtccattaccgccgcaagaaaggggaatgaacatgaaaagaactgcaaacaagttccagcgggcctatatggtcgccaaagcccgcgtgcaggaagtcgaatcccagcaagaagccatcgaaaagaagttcattgtcgacaaaggcattgtcaatcccgacggctccgttcccgaattcctttactgcatggaggatgacgcggcctttgaaaaggcgaacgacgaatgcgccgcgctgattgtttccgccgggcttgaagaagaactgaacgccgcccgttccgtcctgaaagcgtcggaagatagcttgattgcctacggtctgtcccttgctcccgctggggtccgggtcacgttggaaaaggccgttcagcacaacgccgcaacccgcgcaaaggtccttgacctcgcgttccggcttgacgtgtccacggtcagcgcgtaagatgaaagcaggcggcgcaaacgccgcctgccccagcaaagaaagggaaatttgtatgaacaaaatccgtcgcaaggctcttcaagaaatcttcgataaactgtccgctctctctgacgaactcgaatccatcaaagaggaagaggacgaaagccgggagaatatgcccgaaagtctgcaaggctccgaacgctacgatcaatcagaaaccgcgtccagcaatattgatgaagctatggaatatatcaattctgcgtgcgacagcatagaaagtgcaatggagtgataatgatgaaacaaaaggccgaaatggtccgaaacggtatgattttggtcccgaatatttccgtagaatacaagggttatgctatatgcccgaaacttgatatgggttccgtcccgtggcaggttgccggaaatcaatatcagcgcggctatatcgtgacgcggaacggcgttcaggttatgccgggggcggcatggtttacttctgtaattgaagcgcgtgttgcagtcgatattcttattgaatccaacggggacagttcagcgttctggaatctctggaatgagtatagcgggctgaacgaatatgaatctgtgtaacaaaaaaagcccgccggggaatgacccgacgggctttcgtttttgtccgaatcggacgtgtttagttttctgcgggttcggtctggacggcctgttcttcgatgccgacaagcaggctttccacggatggggtgtcgatgtagcctttcaaattctcattcgcgccccatgctttcttcgcttcctccaaagcggcttcgatcattttttcaatatcgctggacgtgaaaagcagtttcagcaccgccgggattcgctgataaatccagtccgcgacggcggcatatttcagggaacccgtaccgcttccgaactgcttttcggcctgcgttacaaggttgaaaaggatttgcttcaaaatctttgtttcgccgcgcttgataagcacgacaaccaccgcgaggaaagcgacgacgacaagcacgctgtcccaattcttcgcaaggaatgtaagaacgttcatttctgtttctcctttctatctgtcagccaatgacggtacagccggattcagggacccagcccaaaccgtcgatgtgtacgccgcacttgcggcccgtatagtaatacttcactgtgtacgttccgttcacagtcttaccttttccgccgccgttgctgtctcggtacagcgggccggaatacttcacctttgcgccgacgcgcattttcggcgcggtcgtaccgctcccgacggcctgcacgtccgccgcattgacccagccgtaaacggtagaaccgccgccgggctgtttgataaggtggtaggggtgctttgcgccctttgcaagtgccgttacctttgccgttcccggcttgcaggccgcgccgcttgccgccgccgcgttggtgtaatgggtgttgcccgtaaagcgcaccacgtcgcccacagcgaacgcaagcgtcgccggggtggtagttgtgccgctgggctttgtcgtgcttcctgcgccgtcctgtgcgccgcctgcggtgtcgtaggtgatatacggcaacttcccgtgcttcgtccacttgcgcccgttcatgccggaaatagcgccaatgttcaggcacgccgtcacctgcacgcagttcttgaaagcgggcgaacattcgatgacctttccgccgccgatgtatacgccgatatgaccgggcaaccagacagcttcacccggaacaatgccgctgaaatcagcggacacgccggaacacttcgtaatcatggtgtcggccccaagatcgggaacgccgttggaagcataggccgcgccgccgtagggcttcgcggcattgccgttccagccccaaagaacgcctttgataaggcacacgcagtcgaacccgtagacgggcgggttcttatccgccgccgcccgaatcattgccgttcgcgcggcctgcttgttgtagctgtgatttgtgcaatagcgggacacgttcgcgcctgtcaggggcgcaccgaaacagcccatgacgtacagcgttttatagttgtccacaatgttttgcaatttgttgataaattcagacgctttcattttgcccgctcctttcgcgtctgcggggcttgtggtccccgccgtggtatttgacccgccgggctttgcggcgcttcctgcgccgtcgtaggcggtcagggcgtatgtttcgatgatttgaaccagcttgtccgcatatttcgggtcggtcgcatagcccgccgcggcgattgcccggcacgcggttttatagtcccgctccccgatgaccgctttatagcgggtattgcacgaaagcaagtcggaatgatcggcgacgctttccgcccaactgccataggcccggaaaaggcccgtcacggtcgtaaaggtcacgccatcgtagcactcttgcgttttgccgctgtaaacggccccggtccagcttgtcccggccttgatgccgaacagggcgtttcccttgaccgtcaagccggatttgccccagccgctttcaaggattgcttgcgctatcgtcagggacgcgaggaccccgcttttctgcatatccgccgcggcaagtgcgcccacccgctcgatgaatttcttttgttcctgtgtcatgtgtattcctccgttacggctgaacgttgttcaggtcaacgggcattccctccgtttcctccgggttcgcctttttgattttcacaacgttttccgcctttgctttccacgaataaaagccgatgaccgttgccgttggtgttccaacgtaggcaaggaaaacgccaagctgtgaagcgtcgaggacgacggcccacacgcccacgccgaacccggcgaaataggtacagaggaccgcccaaagaaccagctttgaacactctgtcttccggcggttctgcttgccctctcttcgtcggcggggccgtcgtccgctcaacagcaggacggcggcgaacccgccaaccaacccggcggcaacgctgaaaagataaatcatgccgcgccgcctttcttactcttcgtgttcgcgccgctcccggctctcgaacgcgtcaagtcgcttgtgcgcctgtttcgcggacgcttcaacggcggtcaggcgcgtaacgacttcaacgttcgtcttgcgctgttccttttgctccgccttgatttcgtccgtgttggccttgatatagccgatttcggtaagaacggtcgcgtcgctcttcgcttcgtcggcaacgtcccttttcccattccgggcaaaggcaacgtagccgaatacgatagcgcaaatcgtactaacgacgctcaaacctgcaagcacttcattcatgttctttacctcccgcaaatgaagtccccgtaaacgcttttcagcgaatacggggcgattgtgggcggtgcttcctgcgagtgataaaccgcgcagtcatacgcccaaatcaaataacgcgttgtgtcctccgcccaaatagcaagcggcataatgaagaaccacagcaggccgaacgccgggcagatttggcccagcacgtttcccggctgattgctgtaatcccaaacgcccagccctaaccacaggttcagtacacacccggaaataaactctaccgcaagcacgataacggccccgatgaccgattgcacgatgaccggggcgcggtaaaagcgcgggttctgattgatagcaccaaccagaaccccgcacagcccgcctacaacgaacatagacgggtgggagtacccacggaaaagcgtttcaaagacgacgtaagccgcgcccagcgtggcccaaatcgtcaagatacgtttcacgcgtcgccacctgctttctcgatcagcgccgccatgcttgccgcaaggtcggcgggcaggtccgcgccgtacacgatagccgggatttcatcaagcccggcccgtttaatccacgcgttcaggtggttgcagtaagtgcggtgatagaagacgtgggcggtcgcggcctgtgtaagcgcggtgaattcctctgcggtatacatacggcaaagttcaccgtcggcgtggtatggcacttcctccgcgccctccttgaccgtctggaactgcgccataagttcggtttggtcgtgttcggtcaggctgtaatgtgcgccgcccacgtcgattccggcatagatagccgcggaacacgcaaggccgatttccgctttcttcgccgtgcggacctgctcaacgtcgttccagtcctgcggcggggtcacgcccagccgctccaacttcatatcacgaatgctgtcttctctgtgctgaatgctcattcaaagttacctcccgcagacgtaatgaagcaatcgcccgttgccgttccgcgctttaccttgatgcggaaattgtagccccaagcgctcgccgttttggtggtgttggaaaggaagaacttacttccgcttacgacgttctgcgtcacgtcctcccacgtcggggaagcgtcgttgccgttgttgcagacttccacggtgaattttgcgcctgctggaatttgacgcacgacagacatgatgccttttgtcaccatatcatcggcagtaagcggggtagcaagcgtaagttcgatttccgtttcatttttcgtgaacgtatacgtccgggtcgcgcttccgccgtagttgtccgccgcaacgattttcagcgtatgggacccgttcaacagcttcacccactctgcggcggtgatgttgaatgaataggtctgtccgcttgtcgcggtgtaggaacgcttctgcgtgccgtcgatgtactccgtcacggtcaaggtctgcccgctgtcttcgtccgttacgctgtaactctgcgcgaacgcggctgtcttcgttcccaagttggaatccgcgccgctgataacgggcgcatggttatttaccaccgtccgcgtcgcgcttgtctgatacgccgattccgcgcccgcgctgtcatacgccttgacgcggtacgcaatagaggtccatccgaacgtgattgcgtcggtgtaactgcggttgatgcccttgtatacctgcgcccatgcgccgccgttgacctgccgttcgaggatatagccggaaagattgccgtcttcgtccgtggaagccccccaactgatagacaggctttcgccgccgcgcacgctggacggaaccgtgatggaagagggcttcgagggggcgcggttccaaatgatcgtgtatgctccgtcggaatccgggctatcagataccaagattccagaggacaaattacaaagcgggcgaacgccgaagtagccgccgcaagcgcggccccagcccatcgcgccagaggaattgacgacgcggacgtagtaagagtaggacgcgtaagcgtctgcaagccaccaccaccacggcgaatttacgttcaaactgctgttcgtgtattcgctcttgctcacggcttccgccgtggggtaggcaaggcgtgaactgtcgttgctgaacaaggccagcttgcttcccgcggtcacgtcgccggacaagccgacttccgtacaggtcgcaaggaagattttgtcggcgcaactctccgtaccgccgccgtctacggtcgccttgcctacggtgtgggtcgtagtcagcagggccgcaatgaagttcgcggagaagcccgcaagaaagcccgcttccgcgtcgtattcgttgtagttgctccatacgttcgcattcgtcgggggcgcgtccgcgccgtgctgggcgctgtaccacttcccggcggcggcctgactgttcagccattgccgcacgttggaaagggtccaacggttattgccgtaactgcggcggttgccgtcgctgttgccggattcgatagcgtcaaagcatttcagcgaaataatgcgctccgtaatcagggtcacagcgccggacgggtagcccgtgtgtcccttgtcggcgattttccaaatgataggcttaccgttgtaaagcgtgcctgtatctttgacaagcgcaccgacggcaagcgcattcaaactttgggccattgtttttcactctccttgaatagattttggaacagactgtcggttttctgtatcaggtgatagcagtttccatttacggcgtggctccgccaacttccgtatgactgttcaatgtctgaaaggctgattttctcccggtccagtagaccgcgctgtttcttcaatttgcgttgtgcgttacatttgcttgaccgccggactttgcgaatgattttgcccgattcggtcaagtaggtgtggaagcccaagaaatcaataccgttccgcaacgggaaaatatttgttttcttgttcatccgcaggcccagccgggcaacgtattgttcgatctcgccccggcagtattgcaaatatgccttgtcctcatgtatcaaatagaaatcgtccatgtaccgcccataatagcgaatacccagcttttcttttatgaaatggtccatgcccgaaagatacatgacggcgaaccattgtgaagtctggttgccgataggaattcccggattttccgtgctgtcaacgataaggtcaactaaccacagaatatccgggtctttgatgtacttccgcgtcatctgctttaacggttcatgctggattgaatagaaatacttcgatatgtcgcatttcaaaacccagccgtccgaatagtgccgcacttcctccgggccgggcggcggcaatcccgcggcccgccgctcccgctcggcgttcgccttgcgtgtgaagtagtaggaccgcatgaattcttcaaggcggtataacccgtcatgtgttccgcgcccgctctgcgatgcgtagttgtcccggataaaggcttttgaaaacgcgggttcaagtatgttgtcgcatagggaatgttgaaccaccttgtctttgaatgcgttcgtcataacgattcgttctttcggttcatagaccttgaaaacgaaataatctgacggtcggtatgttttggttttcagcatttccgaaagtaggcatagggcttcaagaagatttgcttcaaattttgcaacgctgggtttgtgtcgcttgcccctgcgtgctttcaggaaccccgcgtataggttcccgaaatcatatacctgctcgaattctgcgccttgcatataaaaaactccttgccgtgtatagaatcggccttgcgcgtctgcggctcccgccgcacgcaacgcgtcatcatcggaccgcgccgcgcgtccgcggcgggcggaagctggtttccgtggaccttgcttcaccaatcttgtatttaccgtcatgctgtcaccacggcggagggatgcggcttcctttgatagtggtcctctgttttcagcctttcggcctactcaatcgcggtttccaccaaagcgggcgaacgccgttgttgccgttgtaagcgttgttccagttcatcgcgccagaggaattgacgttgcggacgttgtaagagttggacgctacaagccgcaccccaagaaaaacgccgggcgttaccgccgcggcgtgattcctctattctgttgtagtgcggcgaaccgctctctatcctgcttcctccactttgccgtcatgttcttcacgttcataacgtgccgggtccattccgcacattgttcggaagagataagttccttttcaaaggaaagttcgatcaggaaaagaaccgtcttgcactctgtcagcgcctttttctgttcgtagcgccgttcgcggtattcctgcgggtctgtaaggtcaagttcgttcgcttcctgtatgtgttgaaaaatatcaagcgtcaaatcatgcaagcggtttacgatagtaaaacggtatttcttcggaaatctccgttcgcttgtcatcataaacgtgtgcttgactaaatctttcgctttcgtgatgattgcaaattcctgttgcgcgggcttttgttcggtttgtcgctggtctattttagacaccgcctttcccggatttgttcgacttcctccggcggtccgtcaaaggtaaatccgtattcggtgacggtcagcgttgcccgtgtcccggcgtatgtcgttccgcatatcgtcaggctgtccccggcggcgcaatggtcgcagggtggttccagttcgacgaacaggtttccgacgatgcaggacagttcccgccgcgggcaggcgtattccgtcaacattcgatgcgctttctttcttcgttccagatacccttaacaagcgtgatgccgtcgagggaatcaaaggacgcaagaaacgggttcccggtgatgttgttgaacaggccgtcttccacgcgagaaacgcggctttcaattcctgcaatggcgttaagcgcttctgttactctgttcgcgtccgccgccgcctgctctgcaccctccgtccacgatgctttttcttccgccgtcacatgaattttcgtatcttccttatgttcgatcagccccgaaattgccgtgtcgtaatttcccatcgtagacgggtttacatgaatatccgtattattcgcgtgtgcgtttaggtcggtaacgtctgcttttttctcaaactctgcggcgtgtgccgtcttcgatgcgtcgtggtcttcaatgtctttttttgttgccgttactacgttcgggtcgatgataaaagagatagcgtccgcgttggaaatctcaatgtgcatcgtcaattcgatttcgcccgccgctccgcttgaaatgatgactttttccgtgtcaggggtattgcaaaccgcgataagggtttctgtttcgtccagaacgcccatttcgcggattgtccacccgccaacatcggacggaatcaccgctaccacgtcaatcatgtttggggatttctcgttgatctctacgcggtttacttttccgcgccacttttcgccctttaatgcggtcatggtggaattcggcttgtagtagcttccgccgccgtcacccacagcaaggtccgtaatattgattttctttccctccatgaccgccgccgcaatcagttgtattccgcagtcggtcacaagggttccatacgttttatctgccatttcttcaccctccgttcgttatttatttgggaatactgcaagtttccgcccgtactgcgtatagccgccgcagtagaacccgccgtgcgattccatatttcgtgccaagtatgggtagacttcgacgcgttgcccgatagcgtggacggcggcaaccttgaccgccgttcgcttttcgatttggtaactgattgcttcaaggtgggaccgcaggtttttataaaaccgcacacggtcgaggaccgccgcttgacggtctgcggtgatgcccgcttccgttgcgcctatgacgacgcggaatttatacgggtcgccgccgtactcgaaccactcttccactttcgttccggggtacacagcccccaacgccttttcaacagcatactttgttcccaatctgcggtggacctgtatgctgtcccgaatggtccggcgctttacctcgataggataggaatagtcgtaccagtcaacgtgcaggtcgtaagccagcacgtccaacgtcgcttcgtccagttcgtcgatacgggcgtaaatgatgttctttcggacttccgccgcggtcgtctgcaactgcgctgaaatggtctgtgcaagtgccatcatgtcagggtcgtttttcagcgcaggcggaagcgaattcgtgaagtctgccgaatagaagtcttcgttattcacgttccgcacctccgttcacgacggaaaccgtgccgacttgtgcaactgcgttgtctgccacagccgcaaagacgggggaacggacttcaacacgcttcacgcccgtttgcatcaacaaagcgataagctgggaggggttcacgtcccgtcccatcttttcggcctgccacttctggaaagacttcaccgccgcggcaacatccgccgcgatggtgtcggcgctcaatgcgccgccctcctgcgtgtagtaggtcacgtcgatgttgtacgggacggcctgcggcgcggcaacggtcacatggtccgtcagcgggcgcaccgtgtcggcgttcagaatgtccaaaacctctttcaagatttcttcccccggcagttcgccgcctgtcagcagaacgcgcacgtctacttctcccggcttcggggacgttgctttcacgtctgcgatcagcgccgacgcggattttgcgaaatactcatacccgcccagcggtcccgccgtagaataggtttccacactctcacgcatacgctcatagaatgccgcgtcgctttccctgtctgctccccctgcgctctccgttatgttctcgacgctttcgtagtaagggaaaacgtctatcggctggttgatttgtccggggataaatccgtttccgttttcgccctctatttggcactccgcttccacgttcccggtccgctgtcccgcaggaattgtcaggtcctccagcgtagcgaacacgatttcaccgtcaggcgtggcccgcgtgcctgccggaatggtcgttgccacttccagcgggatagaaagcgtatattgcagggtcgttcgggccttttcaggctccaaccgctccgcgcccttgaacagttccgcgagggaatccagatattcgccctctgcataccgcggtatattctgtttcgcggaaaagtcgatgttcacccgctcttgaacgataatatcggcaacccacagaatgaacagtcgtgccgggtccgccgggtacagcgtgcgcccggcgattttttcgtacccctgtatcagcgcattcacgattgtttccgtgtcggtttcgacgtaggaaatgtcggggtatgttctactcttcgttgtcaacgatattcacctccaatacggggaccagcaggcccggcgtttcgcccgcttcaaacgtgacgtttgttacctctgcccgcggttcatactcttctaccgcgtccagaacctccgaaatcaagatagattgtgcaacctgtatcggcttgtcgatgaaccgttgcgccaacccaagccccctatcgagtgggacagagaatttcggcgttgacacgatgatagcgacgttctgcaaaacttcctcttccagcgtttccggcgcaaggttgagtttgccgggcgtaaaggctttcacgatatatgccatttcccgccctccttatctgactgcgtaagactgcatcgtaacattcaccgacgcgacaagcaggttgccccatcggtcaaaccgcttcaaggaatttgacagcttcgtaatgacccatttgttcgtgccgtaggctttcggcccgatgacaagtcggtttacttcgccccgccgcatagcttgaagcaggcttgcaatttctttgatagggtttacccccaagaacacggaaaagaacatggtaaacgttatcgtttcaacgtctgtcccggtgaattccaacaggggttcccgtaagtgtcggtcgtgggtggaatacttcgccgcgctgtcccatttcagactgtcgaacgtcttgatttggtctgcggaaacgtagaacgtgaagtcaccccaattcccgataagcgccattgtttatatccctccaatcacgaacccgtcgccgtcgtccgtcgggatatacaggcataaaacatagtcgcccggcgacggcaaccacggggctattttgacggcgtgcgaatgggcggcaaaggcggcttcaccgcttccgccgctttcgctttccgtcctctgtgccgctccctttgccggaatgaacggcgggttcttgatgacctttagttctcccgacacaagcggcgattgccccttgtcctcgaacgtgacgcgggcggtgcggttcccggcgttgaccgatgaaacccggcccgtcctcacgatatttttcaaaactgatagatcggccatcaatacccctccaatacccggcgtagcgtcaaatcggttttatagccgctctttgacacggaatgcgtcgccgtttcgatgatgtatttcccgtcgaacgcgccgtagcccgatacctgaaccgtgatgccagccacaagccgcgcgtccccagtcagtttgaacgatgccttgaattcgcccttgttcttctgccgcaggcgcttcattgccagttgccgggcttcctctctgttggaaaccttttcgttcacttccagaacttgaccgtccttatccgcgtttcgcggggtgtaggtgtattcgatggtctttcccgtcgttgggtcggtataggaaacgtggcacttgctatatgacgcgtcgtgcaagctggttgaaaaggaccacgaactaacgtccgccgtcccgcgcttgatgacgcgcaccgcgtctttctgctcataagccgccgcgtcgaaaagaacgatgatttttgcggtaactttcaggctgattcccgcggccttgcaaagccgttgaagaaaggtgatgtccgattcctgtatctgctctttccgggtatacagagggtcgaacgcggattcaaacatacaggtaagcccgtttttgcccgcaatttcctttgcgatgctggaaagcgtgtagttctcccatgctttcgttttcttctgcgtccgcacggtggacttgtagggaatggacccggccttgatggtcgcttttgcgggcgggccgctcccgtccacggtgtcgatttcaaaaacgccacagtcaagcacacggtctttcccattggattcccaattcttttgaacgatgacggcggagatttccacgccctttgacgcgccgggtgtgttcagccagtttcccagccacacgccctcgcggtcatcaagcgatagttgcaggtcgtccgttttatcctcttcgttgtccgtgtaggtcagcgaaagaagatgcttgtttatgtcggtcgaaatgtccacccccgcaaaggtcaggcggacagcggttcttcgtgcattcattcggcagtccctcgcttccacggcggcaggtcagaggaaacccgcgtttccggctctggaactgtcagtgtgattccggcgggaaaaacgaaagtgcggcggtactgcgggttcaacttcataaaccggtctgtgtaggcttcgtcgcccaatgtcttataggcgatgccgtcccacatatccccggctattgtggtgtatttagtcatagttccgccgcctttcgtcgtcctgtctttgccgctcccgctcgtcgatttcgtccaacaactcttcgtcgtggcggcgtagcatttcttcaatgtcctgtgcctgcgcgtcgttgccgacgtggaacacgggtgcgctgtgaatgacgacggacgttctaccgtcgcctgcgttcagggtcggtgcggcaacgctgggcgctcccgcataggccagttgatacggcgcggcccctgcggtgcgaatagcgtttaccgtgtccgcaagattgcggaagatgcttcccgtctgcgccgcggtgaatacgcttcggttctttgcgttggtgataagttccgcgccctgctcaccagctatgaacgtgtccggcgtgctgtctgtacctgttgcaaactgcggtatcaacggaatgttgatgccctttccgccgatgccggggacccaatcagggattttcagcttgttcaagccggaaatcgcgccgtttacaaggctgataatgccgttcagtacgccgcttgcaatgctctttagagaattccaaacgccgctgaatatgcttttcacgccctcccaaacacgggtccaatctcctgtgaagatgcctgcgaaaacgtctacaaggccctttatcgcggtcagcgcaccagatacaacgcccttgatggtttcaagcgcaacgccgatgatgctttgtatcgtcggcataaggaattgaataactgccatgattgccgttgcaatggtggaaaccacttccgcaagtccttgcaggatagaagcgatagtcggtgcccactctgcgaacgcctgcgcgatctgcggaagcacggtcccgacgatgaaagaaaagatttgctccacaatcgggcgaacataggtgttcacaaactcgatgaacccggaaataatattccagacggtttgtaaaatcgtaatggccccgtcgataacgcccgttgcttcctctccgaacaggtttatcaggaattgccgtgcgccgcccaagttgccgtccgtgaagacgttgcgtatcgtatcgccgatgtttgttattgccgcaaccaccttgtcgaaaatgacaagtccagcgtcaccgaacacccggcccacgacttcgcgcaccttgtccagattgtcccgtaggatttggaccgcggcaacgatcagcgaaataacgcccaccactggaagcactttgccaagaatgccgctgaacggccccaagatagcgccgcccagcttttgaagcggggcaatcagggttcctattttcccgaaaccctttccgataacggaaccgattttacccagcggacccgccgcaacagcggtcccggccttgcctaatatgttggtgattgtcccggcaacgcctgtgaatgcccgcgtcgcaacgccgcccattcccgaaaacagcttcgagaatacgccgcccgccgcgccgccgattttggagaacgcgccgccgatttttgttccgctgaacatttgcccgaacgcgcggcctacaccgcccgccgcggacccaatgccgccgaaatacccggtcacgctctttgcaacgcccttgacctttcctgcgaacccgacggcttccacgcccgcaagcgctgtctttcccttgaaaagcgccatgaccttttgaatagtcagcacgccgccttttagttcaaggaagcccagctttgcggtcagggccgcggccttgaatgtcaacagccctgccgtcacctttactatggtccgcacaagttccgggtttgcgttgataaattccgtcagtttggaaatcagttcggcggctttctccgctccctgtgtgaatgtcggtaacagtgcgtcgccaagcgcgatttgcaggccctcgaatgcggatttcagcagggtaactttaccctcgaaattgtccagcttgatttgcgccatgcgctccgccgcgcctgcggcgttgttgaccgaatcggacagtttcttgaaatcagcgtcgcttgcgtttacgatagcaagcatacccgcgaaagactctttgccaaaaatggcggtagccgccgccacctgttcggattcggaaagcccgcccaaactggaccgcagattgtcgatgacctcgcggaacgtcttcatgcttccgtctgcattcgtcaggctgattccgtacttgtccatgtaggcttgcatttgctttgtgggcttcgccatgttcgcaagggccgtctttaggcttgtgcctgcgacttctgccttgatggacgcattcgccatcaagccgattccaagcgacatatcttccacagagtagcccaacgcgcccgccacgggcgctactttctggaatgtcgaacccatcatagaaacattggtgttcgcgttggaagatgcctgcgcgagtacgtccgcaaagcgcccggactggtccgccgtcatgttgaacgctgtcagtgcgtccgttacaatgtcggaaacctgccccaagtcttcgccggacgcggcggcaaggttcataatgccgggcaagccgcccaacatttggtcggtcttccaacccgccatagccatatattcaagggcttttccggcttcaactgcggtgaactgcgttgtcgcgcccatgtgcttcgcttcctctgaaagccgcttcatatcctccgccgatgcgctggaaatggccttgacggttgacatttgggcttcaaattcagcagcctttttcacgggtccggcatagatagcgccgcccagcgcggcaagggtcccaagcgttcccgcaagctgtgtcttcgtttttgagattgccgcgttgttctgctcaagggcggcgcttacctttgccaattcctcttgacttttctttaccttgtcataggtctttgcaagccgttcattctccgcgctcaaattcgccgtgttagcgcctgcggcggacagttcggaaccaagcgtctgcaaccgctgttcctgcgcttcgattttcgcagttgtcgcggcgatctgcttttcattcttcgccatcttctgccgcagttcttccgacggggcggcggtttcgctcatttcccgtcggagtttgtcatgctctgcggtcaggcgttccagcttttgacggttcgattcaagggcggcttcctgttttttgtaagcgtcgattttcccggtgatggaatttagcttcgttaggctgttctgcatctgctttgtggtgttcaacgcgctttgaaaaaccgtgttgaagttgccgcccaaagccgcttgcagtttgaaaagcagttcatattcttttcgtccagccaaattcaccaccccttttcgtctatttctgtttcgcggcggcgttgatgtcctcaatccacgccgtaatttccgtcatgttcatatcaagccagaacgggacgggcgtatatgttgcctgcgccagtttgaagcactcccgccgccaccacttcgccgggctttttaatagcccgtgtcgattaaaaaactccttgccgcgttggtgatgcggttaaagtccttgataggcatagcgtcgagaacgtcgctaccaatgcccgcggcctttgccgccattttcgcctgaaaactccgggacacttccggcgcaaggcagtattcattgttcatctgcatttcggtttcgatagaaaccatgtcgcggcccgtcattttctcgaaatcgaacgtcagggtcgtataggtttcgcctgcgtactcgaaaggcttcttgaacgtgtgcgtataaacgcctgcgtcagcctgtacggattcgtttacggcttccgcggtcatatcatgggtgacagcttccgccgcgcctgcggcgttctgtgcgctctctgcggcggcgttcttgatgttctcactcattgtcaattcctccgatttagaaattcatattttcagatacagaaaagggcataataaaacccagcgggaagccccgccgggttttacttgccaagtgcctttcgcacgtcttcgaggtaatcaacgccgttgacgtagtagataaagttcagaatgtcgatttccagaacctttttaccgtcgatgtacgttgcgtagtaggtcacgggatattcgccggacgcttccgcggaagatgccggggccagcttgccgggggcaaactttttcggattgacgacaaggacgtgcttcacggcctgctggacatagcggcccgtgctgttatcccaagactgctgggccgcccgcaaatcaagctggtgcttgcgcggctctgccagcttgatagcgtccgtagtgacggaacggaaattcagggtcagggacatagcttcaaggtgtccgacaaacgttccgtcgaacgtacctgcgatgcccgcgcccttgacctcttccgaaatctgcgtgatttcaggaagtgtgacttctgccatgccgtaatattcggtcgcgtcctcatatacggcaaagttggttacgccgttttcaattttcattgttctttacctccttacgccgacagcgccgcagtcacatagtccgcgtcgtattcaaggacgaattcgcattccctcatggggcttgcgggggtcatgtagatatggaaaacagccttgcccgccataagcgcggtcgtgctgttctcttcgtccagaaactccacgcgtgcgcccaacagcttttcttccgaaacaaggccgttcagccaaatgtttacggaatcaacgatgctgtcgataaggcggcgcgtcattttcttgtcgatcttgctccaataagtaagaatgacagaacgggcaacccaaccgaacatacgggaaacggaaatgaagtagttcttcacgtccgtatcggcggggaaacaggcggtttcgtcgccccacagcacatagcttccaatgaagttcagcgccgtaacgataccgttactgttcaggtagtttgcctgcgcgagatcgagaagcacagtcgttccgtccgcaagcatagcgcggtcgatctgcaaggacttgttcgacgggctttccgccgggcaaccgccgttgtccgaatcggtctttcccatcaggcccgcggcgtggacggacgcatgaaacgcacggtcgcccagcccgaacataggccagcagagaatttccgccttgctgttcatgttctgtgctttcttccatgcgggaacgtccgcgtagtggcgaacggtgttggtgtccgcgtcgatcagggcttttgcacccgtgaacacggtgttgattgcgtccgcctttgcagtcataaccgccgcgacgttggatttgtcggaccagccgggggcaacgataaggtcggggacgatgccgtatttcggaaaaaccttgtcgatcagttcaagaccggaatacttcttcgtgctggtatcgaaaccgccgataatgtcgttttcgttgattttggaggggtccaccgcgtcgaacgtgattgtcagttctcccgtttcagcgggaatactgccgccgtccagaacttcaagaatcaggttttcgccctcatagaaaagttcatagtcggtcccggcggtgtagcttgtcaccttgaccgtgtttttcagggcttcgaggggaagcagaacttttccgtctgcgacggggtagttctgttctgcgacgctcttcttgtgcttcgcagggtcaagcacgttcacgaacaccacaggggccacgccgtacagcttgaactgcgaatagatagcttcgcagattgtgtacttctcccaatcgtcgctataccccaaagcggcgacggcttccgcgtaagactgacacatgatagggtcgttcggtgcgccgcccacggtatgaccgggggccgcgccgacgacgaacgcaataccagaatcggcggttacaggggtagaaatcgacgtgtcgttctgacgcgtcgaaacgccgtgaaaatagtttgccatcgtttatacctccttgtttcctcgcattgtcgaaacaatgtcgttgtaatacttgtgcgcgatattgccgggggtcttgacctttgcggcaaacgcggaaagccgctccacgggaacgatcagacgttccgcctgcgggtagtcttccagcacgtccgcaaggtaggctttcacgtcctcgaacgtaccgttgaatacggcgtgttctttcaagcgtccgtgcgggagggagggaccggcatacacgaacaggccgtagccctccggggcggcttcctgcgcgtcctctgcgggcggctctgtgtcgctgtccccggtagtgctttcctcgccgtcctgcggctcctgtgtcgcttcgtcgcccgccgccgggtcgttaccctccgggggcgtttctgcgccgtcctgcggctcctgtgttgcttcgtcgccctccgccgggtcgttaccctccgggggcgtttctgcgccgtcttgcggctcctgtgcgccctctgcggcgcgtgcctgttccagcagttttagaatgtcgtttttcttcatgctgtcgtcggcttcgatgccgtgttccgcggcaatttccagcagttcgtttttgctcatgctggacttgaattctactgccatatctgttgaacctcactttcgataatcggcatggtccatttcgtcatcatttcgcccaaatagtaaggggctgtgctgtccgggtacacaatcatttcaagtggagatttcaagacgaactgcccgccgacaacgccatctttcagcagggcgacacgaattcgcgtcagcaggttcaagacgcacattgcgccctcgctttcgtcctccgaataggtggcggcgacgatacgcacgatgcattcgctttccgggtcctgtccctgttcctgcgtgtcggtgcttttgatgtactgcaacagcaggtaggggacccgctccgtttgcgcggttttgttcggcaggcgcattttgtagacctccgccgcgcgttccttgttctctccactcttgcggtccacccggacgggtaaaagaatgtcttttgtttcttgcttcacaaacgcttccagcgcgtcaagcagttgtaaaggtgtcatgcgttcaacctccgtacccgttcagaatgcgggtgatttcgtgttcaacgcgcttgttgatgacctcttgtgccttttcctccacgtcggcaagaacgatactgtttcccgccatctgtgccgtagacggtcccatgaactcgctgataggcaggcgctttgaaccgtcgcgctcgaacatacctgtatgtccgctttgcattcgtgcaatgaacgcgtcttgaaagggcgtgcgcccgtttccggcaagcaccgccgccgacacggtagcccgttggataggaattgtcggcgatacgttgaagcggtatagcggtatcttgtggcccgcaaacaggacagttccaacaattccgccgtcgctggactgtgtgcggaccttgattgtcgtttccgcccggacgttctgccgcgtgattgcataaacggtcgtgatgccctttagggtttcagaacgaacggtattgttcgcccggcggatagtgcttgacagcgccttttctattccgccgggaacacctgacaaaatcaggttgacccgctcgatctgttcggctgtaatagtaatcattcggtcagcatctccaaataaagaacgatttccccggcttccgggtgaacctttgtgatttggtaaatgtggtcgccgatttccatgttcaggcccttttgcggaatggtcttcaacagtgatagcgggacatatacaacaaggtcaacaagaaccaagccgtctacatggtccgtagacggctttttcctgtcctgtgcgccgccgtcatcaatgatgacagggcctttgtagcgcaccccgtcaatccagaattccataacgtcggcgtgttcgcgggcgttatggaataccgctgtaaggtcccgttcaacctgcgctttgaagttcattacaggacctttgcaacgtaccagctattgacctcatggggaacggtcagcggcttactgttgacttgcaggaagcggcggtccgggcggcgctcaacccacgtctgcggcacgcggtcgccctccacggtaacaaacgtcttaccctcttcgggaatcatggtgattgcgccgtagtagatggaatactccgcttcggtagacagcagggcaagcgtgccgtcgggaacaagcggcttctgcgtcggtgcgttggggttggtccagttgtccagataccactcgttatactggtagatgtcaaggcccagcttgtgaatagtgccgatgtaggtaaggccgttcggcagttcgcggggcttgatgactgccaaatcataggcgcgaacgtccaaaacggacttgacctttgcgttgttcacaaaagcgttcgcaacgtcctttgccatgatgcagatattgcagttcacaaagccctctttctggacggcttcgcgccagcgctccaaatcgcccagcgggtcggaagtatcagcgtcccacttcttttcggcgctgacgatggtttccttgttggtgaagtcaaagtcgataacttcgttcaggccctcgccgataatgggaatctgcccggtgaaaatggcggtagccgccatccactcttcgcggcgcacgatcatttcgttcagttcgcgcaggtcgtccgccagcttctcaacggcacgctccgcgggggtcctgccgctgtacgggttttcacccgcagaacggttcagcaggtcgtcaacggtggtgattttgtcaggggccagcagaacgggggtgtaagtcttcgtctgatagccgctgttcggaaccaccttgccaccgactttcgggtgaacgaacggtgcgagggcgcggcttcctttcttgaagtcaacgtcaacgctcttcgtggggaaagtgcggcggttcttgaacagggtatcgcggaaaaaagtatgcacggggggcattctggtaatcagcttacccagcgtgcgcggggtgtaaatagttgtttcgatagccatttctctttgctcctttacttcaaaaagattccgatattgcggaacgcctttgccagcgtatcggcggtcacgccctccggcaaggtgatagcgtccgcgaaaaattcgcccgtcaggtagacgacgacttcttccgcggcttctgcggcggttgcggcgatgccgtaaattcccgccgtggtgttctcatactcggacttcgccggggtgcttgtgccgctcacggcttcgcttgcggcgacttttacaacgggttcaatgccgttgtccgtcagcttgacgggttcgtactgcttgacgctcttcccggcggcaacagccttgaccgccgtaacaacggggtattctccggcgaaaaacttcacgggtacgctctggtctttctggatttcgtacatatggtgcttcctcctttacttcgtcgcggggaacagcttgtcaatggccttgtcaacgtcattgtctccgccgccatcgcccgcgccctcatgtgcgcccgctccaacgtcgcccgcaccgctcttctgcgcgtcgtcgtcgcggttcttgatgtaagttccgccctgcttcttctgcgcggcaacgatagcttttgccacgtcgcctgccgcaatggggttgttgaacttcgcgtcgtttacgatgctctcatagcccgcaagcgccacgtcttcaatgtcctgaatgcgcttgcgctccgcggtggtcgccgcatcctcgatctgacgcgtcaggtcgggaaaagccgctttcaggccgtcaaccgtagtgattttttcgattccgtccattgtgtttcgctccttttcggtatttttatggttggttttatttgaaaaaccgccgggcgtgcgggccgtcatgcggtttaacaacgatacaggcatattcggaaagcgcgtcaggtcgagggaaacgctgttcacaacgactttcgccgcattttccacggtcgtttccgcgtcctcaaacataagtttgtcgcagaaacccgcgtcaacggcctgtttgccgtcgtaccacgtttcagccgccatgattgcggcaacgtccgccgcgtcctttcccgttttcagggtataggcgttcacgatagactgcttgatgacctttagttcatcggtcattttcgcaagttccgtttcgttgaagtagcccaacagccccaacgccgggtcatgcaccatgaaaacgccgtttccggggatttcgatgctgtcgcccgccattgcaataatcgtcgccgcagacgcggcccatccgtcaattttcacggtgattttcgccgcgttgtctttcagacgggtgtaaatggcatttgcggcgaacacgtcaccgccgccgctgttgatgcgtaccacgatttcaggtacagcgcccagcgcgtccagttcctccgtgaactgccgcggggtcacttcatcgccccaccatgtttcggaagcgatgtcgccgtaaagaatgagttccgggggattgtccccgcttgctggttggaagttccaaaagtgtttattcttcggttttgcctgcggcgttgccgttttctccattttcttttacctcccttaacattttttcttcgcgtttcaactgcgcggcgtttcggtagaagtctgaaccgttcatttccatagcttcgcggtcgcgtgtggaaaaaccgttctgcacgcgcttttccgccgcggtgacttcctgtaccgggttcaaaaggccctgcgccgggccgttccactctgcgcccgtgtacgccttgcgtatcagcgggtcagagaaaaagccgggcgcgggaatgcggccctttgccacggcttcggcgaaccattcttcatagactggttggcaaaaatcatttgcaagccacgtccgatacatacggaacattttccatgcttccagaagcgccccgcgggacgcgctgtaagacgcgttgaagttctttaccaacagttcataggggatttcaagagccgcgccgatctgacggcagatagccacaacgaacccgtcaaaagccgtgttcggtctgccggggttcatgtcgtgtgctttttcgccctcgttcaaatccacgattgcgccgggggcaagttcaatcgtgctgtcgtcgcctgcgtctacttgtgcgtcctctggaatgatttcaccgaacccgccgtcgctggacgcggattctttttcgataaacaccgtgaacataccagaaaccacggcggcgacaagttccgcgtctgtatatcgcccaagctgtttcagcgcttcaatgaccggggcaagaaacggcacgccgcggcgctgtccgatgcgctcccggttcataatgtgaagcacatttcgccgcccggtctttgcgccccacgcttcaacgcgcgtccacccggtttccgtcatgtcatacgaaagagggtggtgcttgctgatatggtaggccacgacttcgcccgcgtcgttggtttcaacgccgccgatgatatgcgggtcaacaatcccgttcggattgctcaacctgtccgcttcgatcagacaaattcgcaggtcgtaaggcatatttgcccgctttgtcacgggcaatgttgcgataacgtcaccgctcataagccagttcagaaacgcgagttgttgcagttcgtagaagttgtcaagccgttcaaggtcgcaggcggtcgaatcggcccacagtgaaaattcccgctcgattttgcgttcaaggtcgcgggcggcttcttcgtccatttccaacgcttcatagtcgatttgacttttcagccgcaggccggacccgatgacgtttgttcggcaggttttcagcgcacccgtcgccaacggaacgcccatgtagaggtcgcggcaacgttgccgcagggtcgataaattgtcctgaatatcttcctttgcggacccgccgccatacagccagcccgcaagcgatttcttcgtgtgtgatgcgccgtagtttccatacccgctatccagaatatccagcttccggcgggcggcggcgcgttttaccgccgtttgcggggacacggcggcaatcacccggtctaatgcgttcaaaccgcttcaccgtcctttctcacaggtcccgcggcactacccggaacacgcggtttcttccgccgcgggcttcgatgttttccagccgggaaacctcattcgtccaatacttgatgcgttcgccgatttctgaaaggtcggctttcgtcaggctccgcgaaccaatggtatagctttgatgcgttgttacctccaattcggcggcaagccacgcttcaaggtgttttcgcgcgatttcaagccgcgctttctgtgatgtagccatttatagaattcctccgttcgtccgtgaacgcctgccgcgccgccgcggggcgggtgcggtggtgtcatgctccggcggcttcaaaatcgggtttgcgatttccagcgcgacggtcgcatagttccgaatgtccaacggctcgtttcgcttgtagccgccgtctttcagggtccagacgtattgtgctttgccccgcttgtagctgataaccattttttcggcggttaggcccttgaagtattcctgcgtatatccccggtctttctcccgcgggaagtggcagtaattcggcccctcttcctgcaccgccaaacgctgatataaaagcgccttgcctgtatcaacgcccacggtaaaaagcggggttttgatgttgtttgccgttgacggtcggttgaagtacgggacttccgcgccgcccttgcccttgattgcaaacacgcggcgggctgtccgctccttgcagaagcggtaaacctgcgtcgtgaagtgtccgccggaatcgacgcaagcacaaatgattttcaggtgtcttccgtccgccgtggtgaacgtctgcgaaagaaagcggtccagttcgtcccatacgggctttagcttcaaatcaccgtaaataacttgatatttgatgccccagctttccttgtccacgccccagccgacgacttccgcttcaaagcggtcgtcctgaacgtcaacgcctgccgtcagcacaagaacttcttccggcacttcgcaattatatttttcgcggcgtttgtagaggtcgtccgtttcgatctgttcgccatcctcttcccacgtttcgcccatttcggtatttgtccagactttcagaagttcgatgttgccttttttcttctcttcgttcgcagtcaggaacttttcaacgatttcccgccaatccacgaacagggaagcaagggcgttcaggtggaagccccggacctttcgttccgggtgggccgcaacgaattttccgttgatgtactgttctttccactccgtttcgctggaaaccacgccgcaggccgggcaggtacagccgatttcgtccagcttatcccggtcaaatacgatattcgcccacagcaggggggtgaatgctccgcacgccggacaaggtacgttccattcttcttgtgtgctgtgttcaaattcaacagcgatgcgggacgtttccttgttggtgggggtcgaaacgcagacttcttttttattccaaaacgtcgcaaggcgctttccggcaagtaacagggggtcgccctcgttgcccgccgtcgccgggtatctgtcgatttcgtccgcaagcaaaatgcggatagggcgggacgcaagggacgacggcgaatttgcgcctaccatcgttacatgaccgcccggaaagattttttgcaaaatggtgttgccgctgttccggcttttgtcgttcaccttgtcgcgcagaaccggggtatcgcgcaacataggtgaaagacggtccttgctgaatgtttccgccatctgaatagttggttgcataaccataatcggtgacgggtcgtagtgcatatagtagccgataggattcaatataagcgcgtccgttttaccgatctgtgccgcggacatgataacgactttctgaaccctcatgtcgcaaactgcgtccatgatttcgcgttgatacggagcctttgacgttcgccatcgccccggctctgccgatgattcggaggacaagcggcggtatttatccgcccattgtgaaacggtcatgttggggggcggggccagaacggagaaaatgcgggtgaacaggtcaaccgtcgcttttttcatcttctttcaccctttccccgaatgttgttttgaagtccgaaagttccatcaacgcttcgtcgatgtggtctttcagcagggcgaaaatttccgccttgtccgtctttttacaaaggaccggggccagcttcgaaggaatcgccataagccgggatttgaagtttaccagcatatcagtcataacggcttcgatgtcctccgccgcgtgaagctgattttctttcaactgcaattcgtactcttcgtttttgcgcttcgcccgaaccagcttcgcccgctccgtgttgtaatctatggtttcgtcgccctccgggtttcgctttcggaggtagttaatatagcggtggttcgtgtcgatcaggtcatacaggccggggcgaacctccgctatcactttttcgtcgcgtagttgccggacacgccgttctgacacgtccagaaaccgggcaatcgcccgcacgtcgtaaagtttcacggtttttcacccctcccaagcccttatttctcgaaaaaacacccccatactgaaaaaatcggcacggcccggaagcgttcaaaaaaatttcgtggctaaaaaaacgccgggcgtcgcggacccgcaggccgtaggctccgccgaaagaacctatttcaaatttccgggtcgccgcacgggtcgtccacttcgtcgatgatttcgcccgtttcagggtcaacgtcgaacgctcctgatagtttttgcttcgcaagattatatttgcgctcttcaaggcgcaggcggcggctttccatctcataacctttgatagaatcaagtagcttgatgatacgcccgtgtatcttgttcagttcggcttccagtttcatagcgcgatcaaacgcgcttgccttgatgactgtttgcatattgactttgtaactggatttctccaactccatttgacggtctgccgtggtatcttccagcgcggctatttcgcgttgtaatgcgtccagttgcttttgcttcgcctttgacggcggcttaccatccgggccgctgtcaatctcccacgtcaggtcatcacgcttacggcgcagggtttccagtttctcttgctgttgctccaaacgctccgtactctttggcgcacgcatttcaacaacgcggtcaatatacagcgcgtccgggtcgccgttctctatctttgcaatcttgttttgcaggtcggcttcctttgcaatcagaagttgcaattcagaaagcatattcgttcccgtgtcaagcgtgatacttttgatgtattcgcgctgttcgtccgggaggtccgcaaggcgaaccgttgaatatgcgccgtgggtttccgcgtttcggttcccgtgtggagcgcctgcacctgcggcgttcttattgccgggttgtccgccgcgcttccgcggtggtttctgcgcttcaagttccgccgcccagctatcaaggcttttccatttgcggacctgttcaggctttacgccgacttgctccgcaacctgtcgggccgtcagcgtgccgccggaatcaagccatatccgccgggctttgtcacgttccgggtttcgctctctcgccatgcgtccgccgcgccccctttcgtttgtttttcatttttcgttccgggcgttgccgcggaagtgcgtaaaaaacgggccatgttcaaaacatggtccgttttcaggcttccggcggcgtggaggaatgcgccgcccgtatcgttgtgttcacttttcacaatgccaattatagcaggaaaaacgggcaataggtggcaatcttatttttccgggaaaacgtagcgggaaatccgcttgttctgctcaaagcgctttgccaatctatccaacgcaatgtttcggatattccggcattgccgcgggctgtaatttacgcgttgcgaaagacgttcccattgaagcccgtctatgtaaaagccgtaaatcaccgctttttcgcggtagttcagggcgttcaactccgaaagaatttcgccctttatcgcggtcagcctttcgttttcccggcgcatatttgcgatagtgtcggaaacggactgcgggatattcagcacgacgcgttcgacagggtttgaaaccccgcctttcccgtgtggcataccgtcggaattcaccgcgcccaacgtggaatagtattgatcttcaaggttccgaataacccgctcgttcatggtgactgttttatctatatcccggtaaaaatccagaatagcaataactctttcttgcttcattgctccgtttcctcctgttcctgctctatcaaggcggcttatataccctgcggaaagggtgcgcccgctcataatgtctgatttggaccatataccgccgttcaatcagcgcggcccgctccctccgctgtttcctgcggcggtgcttcggctctgcctgtgctacggcttcttcaacttgcgtgatgaatttttcaactgcgtttgtcagtgtgtccgcaatggacgtgatttcgtcccgtatgacctgcaacgcttcttgaatgcggtatatggcttcttccgctgatatgcccgcccgctccgcaagtatcatcgcggcttcacggaaacgctctgcttcctccgccgcggcttccagataatcggtcttgtattcgtccatctgcgcccctcactcttccgccggggaacagaaataagaaaccgaacaaaagattttcacccgctgtccgcaatgttggcaggtgtgcggctttccctccgccgcgccgcgaatgctgtattcgataacttttgccgcgtcaaacttcgccccgcaatacgggcaaatcccgcattcgctacttctggtagcctgcgggcggcgtggtgcgctctgctgggtgctttcggtcggcttcgtgtcctgcgtcccgtctgcggtgtcccgctccacagcggcgctatacggcggcgtggcctgcgtgtccggcactttgtcccgctcgactacgggttcccgctctttctgcgggcgttctgcctgcgtaggtgtggcggtgttctctgcgggcggtgcaggcggggcaggacgtttccattcccgcgcggccttgatggaaattgccccggtcaggtgatattccttaaaggcggcgttctggttctccacaggcaggcccgccaattcgtaggcggtcgaaaggttgatgcggtccgctttcagttcctccgtgaattccggggacaaatgacgaatgatggtgtcatatcgtccgatctgcgttgtgctggtatgaagcacctttgcgataaaatcgcgggtcccgtccgtctgtaactctccgtcttcaaacgtcttttcgacgatgcggcgcaacagttcgacgaaccggggctttgtcttcgctttctccaaaacctcccgcagatagcggacctcttcgattttgtcccatgcggtcttttctctctgcgagttggtaacgatcaggtccagcccgtcgcgtatttcctgttcgtccgccgcttcctctgtcggttcgatgacgcagggtacgaattcgtattccggcttcccatcgttcacaagttcgatagaagcaaggcggcggcgatgcccggcaatgaccttgtacttgccgtcgcccagcggaacgacgacaaggttttgaagaactttccctgcaatttcgattgccgctttcagttccccgatttcccgcatggaatagaaattgtcttccgacggcacaaggtcaaagacgctcaatttctcatagcggctttcagaggggcggggctttgcgctcccgccgcccgccgccgcctttgacgtgtcactcaaaatctggttcaaattaaatcttcccatagatagcccctttcccgtccgattcggacattttagcggtgaacgccgatgcgcccgcggcctgttatcggtttgaatgcttcccggcaaccgtcagggtcgccgcaaccgggccaatacccggcgcggcagaaccgcttgtcggaaacgtcgtcaacgtccagtcggtcacaaattccgcattgatacgcgcggattttctttccgtcccggcagtattccgggaccgccgttttctccgtcattgtttacccctccgcaagtattcctgaacgaatgcgatatagtccattgcggttccgctccgtcggctgtactccacgatagggatttccgaaaaggtgctttcggtgactttatccgaatatcgaatgcgggtgtcaaagacggggtattccgggcgggaccgcaaccacgcttcgccctgcttctctgcgtcggcgcggataaagcaggtaatcaagcacccggcaaggcgcaagcgcgggttcaggtcgtcccgtgtgtcctcaatctgttctttcagttcttccagcccgtcaaaggcgtacttgtcaatctttatgggaataatcacgtcgtcggacgcgacaagggcatttatcgttgaaatgttgatgtccggggcgttgtcgatgatgcagaaatcataaaagttttcttccgcaatcgcgttcagggcggaccgcaggcgcgtttgttgggggcgggtgctgtccatcaggacttccatgttcgcccgaatcaaggtcatatttgcgggcattacgtcgatattctcgaaccgggtcttcttgatgacctcccgcaggtccagccgccgggcagtcagcacgtccgaaatgctcttgtcatcgtaggaatgaaccccgaatgcctttgacgtgttgccctgcttgtcgttgtccacaagcaaaacacgcttgttgtggaacgttgcgaggacgtgggccatgctgtcagcggtcagcgtctttgcaacgccgccttttaggttgataattgatatggtcttcaccgtctaaacctccttttgtggttctcccgctcgaaagcgggtcaacgaacgatttctaccaaacgcccgtcgttgtccagttcgtacaggaacttcaccgttccggctttgacggagtgcatacacacaatgtcggtgatagtccgttcaacgataacgtcaagcgttctgccgcccaccgcgcaggctttcttcctcatgccgactttgtcgccaatctcaaaggggcaaacggcgttgaatgccgcaagtttcattttctgttacctccgtttcgtttgtcagcggttcccggtcttacttccgccgccgcttatgctttttccgctttggagcgggaggggcgggcggttccggctccggctccgccgcttcctcgcagagaacttccagttcctccacgtccgccggggcgaacgtcagggacgcgccgccggggtcgtatgcctgcgccgcccaatccgccttgaatttcacaaggtcgtttttgtagcgtgggaacgggtgtacttgttcggcgtagtaaatcgccatcatcattctttcgtcgtccgccgggtcccaattatgcaggtgatagcttgcgtggttgtcgtaggcccacagggaaagcaggacaaccagcccgtcgaactcttcgttcgatctctggatattctcaaagtcccggtaggtcaagccttgccctctgcattcctcccggatttgtggaatgctctttccgcccgttttcaggcggcaacgaacaactttcggtcgatagttcatgtattttcacctttctttctcaacgggcagtagcgcggggccgtcttcccgtagaacagtagcggacccggcggcgggcattgcgggtgattgcagaaagacgcttcctgcccgaaatgcccgacgtgggcgctgttgctgtttccattgcgcgggtatgtgtggaccgatgcaaattcgcattcgcggcacttcatgtcggttcctcccaattccaccacccttgtttcccgtgggcgggaatgggcgttttgaacatgaccgggttttgaagcacccacgcgaaccgccccggcgaataatcacctaacaggcgttcccggttatccaaactgtccacaagttcttccacaggcacgcaatcgacgatttcaacggttccgatgactgcgccccgcggcaggtttccgccgccgcctgcggcttccagtacggcccaaaactcaccgttcgtcagatgctttgtcgcttgcacttcgtccagccgcccggcgtggacagcgacgcggccccgaatatgcgtccgccggggtcgggtttcataatgcttgacccccgctacgattgcgtgtgcgtagggctgatacacggtaaaggctttcattccgtgtcctccgccgcttccgcgtcaaacgtggtcgtctggttttcgtccggcttttcttcgtcctccgccgccgtggtggtgaatgcgcttcgggtgttcaggaagtggcggcattgataggacagttcttccagttcgtcggcgaatttcttgctaatggcataaggcatgatgaccgccgccgtcaggaaccccgcctttgcgacgatgtacgaaccgccctgcggcgtggtccgctcgtagaattgcaccatgtcgataacgtcttccagcggcgaaaggtacaggctccgaatgaatgtaacaccgttgttcgttttcagcggtttcaagcgcaacccgccgttgataaaggtcgtttcatactcccgaaccagtttgtcgcccgccgccacgtcctcgacgttcaggtgttccggcaagcgctcatgccggaaaaggattttttcgcgttgcttcccggtaatgtcgaacacggcgcagaaactttcttcgtccagaataggcaggccgtccagaggatagagggcgtagccgtcgcccagccattgcgtgatttctcccgatctgtcgatacggtcatacaggtaataaagcccgttcgccttgcagatggaaagaacctttttcagcttcattcgtccacctccgccgcctgctcgttcaacgcctttaccgccgccggaatgtcggcgcggcccgcgttctccacttcaacccgcgtcacgtcgccgacgtggtacacggaaactttgcgcttctgacggaaacccgccgccgtggtcgccacagcttcacccgccgcgacaatcaggaccacacagcccagccaaacccaaaaacttgaaaacacgaattgcagaagttccattttatttccctctttccagcctttcggcgatattcaaaattccgacgattgcttcacgaatgttcgcgtctgtgttcgccgtgatggacaggacccgtgcaatgtcccgcagttcctccgccgcggcgatttggcccgccgccgcgcccgttgctctcatgcagtcagggcagaggggcaggccctccgccgtcggtccgccgcattgctcacacttcgtcagtttcatagataacgctcctttataccgggtagccaaatacaatgacggttcctgtcaggaccgcgcccagcaggaagacaagccacaggataaccacgcccaacaggacgttttcagcccagccgcagacgcgcaaggcccactttgccacggtccaacattgcaggcggcgggtgtgttccagtttttcaaggcccgatgcccgtttcatgtcgtaggtcgccgctttgacctccgccgccactttcggttgcaaacccgctcgaatggtgaacagcgcccaataaagaacgatcagcagaattccggcacgcattgtcagtcctccgtttcccgttcatgcgcccacacacattcggcgcagttttccagttcgcccgtgtcgagcgggcaaggctcattgtcggcccattcaggcttcatgcagtcatacttcatttcgtttcctccgtttcgatgtttcggccccgcagggcaagcattttttcacgaaccagcttatcgacgacgcggcccggcgttttctgcccgctcataagcataaggcgttcgaggttgtaggccgtctgtgccgtgacgcggaccgtcattttctgtgtgtgctgttttttcatggtgtcccgctcctttcgtggtggacgtaatcgaggaatagcaccgccccattgaagcggacccgccattgttcgaggtccgccgcggtaacgtactttctgccgaaatgctctttcatgtcccgccacaccgtccacggaacaaagaagaattcgtttccaatcccgccgcagactgcggcaagcgcaccccgccgggcgtggcgttccagcgtgtcccgctgttcctgtgtcagaacgtcccacttcaaacgatctgtcgttgtgtacttcgcttcaaagactatggagcgcccgccgtcaagcgttccttgaaagtccggctgtgcgcgggcggtaaagcggcccttgaactttccgtcgcggctcttttccagaacgcggaacggttcaggggttttgtctacgtcggcccgctcccggtcagaatagagggcgcaggcggcttttatggcactctcgaaaaagtggccctgtgcgttgttgactttgttttgataccgcagggcggcgcgttggttgtctatcacggtcccaccccgcttcccagcacagggcggcgcgtgtggtcgcccatgcccgccataagcgcttgaagtttaagtgcttcgcttcggctgatttccgccgccgggatttcttcggcctttttggaagcaggcgggaagatgtcgttcttcatcaggaacgccgaatagaaccgttccatttcctcttccagcgcggctttataaaactcatagctgaattcgatttccagccgttccgccgcggtgcagtcaattccgacttgctttcgtgcgcggcctgaataggacccgacgcacttaaaggggattttcccggtcacggtataaatcacctgaaccagcagttttctttcatacggggtcttgtaacggaagaagcacttttccaaacgctcttccgctatttcggcttcgtcgatgccgtattgcgtcatcagcctatcaagcagggcggcggctgactgcttttcgccgtctgcgccgcggtttgcaagggcttgaaccttgcgtatcttctctaacaggcgttcccgctccgtcattgtcatacctcccatgtgtaaggttccgtgcggcacatatcgtagaacgggcagaatgaacaagcgtcgtccgccgtcctgcggtcgcaaatttccttgatgacccgtgcggcctgcttcatttcttcgatttcccgttcttccggggtcggctcatttcttctcatatctcgcagatacccccgatattgtccaaatcggcccggctcaccgtgcggcgtttcaggatacccgccatgacttcgccgtaacggtcccaacgtgccgtcgtggtcgtgaagtagcgcaattccgggttgaactgcgcccgcattttcaggcccgtaaggatttcacttgtaatttcgaggtcaagcgggtaaacgctgacgcgcccgctttccttgtctacctcccggcagacggcaagcagtttcaaccgctcccgcggcttcggcggctcccgctcgattgcgtccttgcagtcgcagggttcggaagcgtcgaggtgtgcgccgcagtccgggcagattttgaacggccttgccatattgaacaacccctttctttattctttctttcgcaatttcaggtagaccgcccaacccgtgaagtcgttgtattcgtactgaacgccgtagtcatcgtcggtcagtgtccagccgggatatttcttttcccaaaactcacggggcgggtgttctttcgcccacttctcaatctgacggcggttgtacttgccgtcgtttgtccggctgtacggtctttcgaggttgtgcgaggaattccaccgctttttcccgcacccctgcttcacaaggtaggtgcaaagggcggctatgccgttttcatcggcttgcaggcggtcagcattacaaaagccgattttgtcgccctttttctgtcccttgcgcctgcgttttctccacaggtcttccacaacgtcacggtcaagcccgccgttcataatgatgtggtgatgtatgcgaacgggggtttcactgttccgctttgtggtgtaggcggtaacgatcatgtactttagcggcggcaagccctctttcttccggcggtactggacccggcgcaggaagtttgttgcttcctgttcggcctgttccaccgtgtcaggcagatattttccgctgtatgtagctgtaacgtgcagggcttccgggtcagaaccgaaattcaggttcgccgtctgcgtgaagtagcggcgggcgttcttgtcattcaggttcttttgcttcggctctgtttccttgattttctttgacctcttcccgcgcgtagatgctgtcagttgcgcggcggtgtaggggtatatatctacctcccgataatgctttccgcagtagattttcttttctctcataaaacttcgcacttgcttcactccttttgcgggtagaggaagcgggcggggctttacttccggcgtgtgtagttgtctatgcaggcaggaagaacaccagataggacgtgtctttcttccctgtcctgttgtcatgcgtgacaaggctaatcgcaggaacgttaatacccattacaagcccgccacgccgcgcaaaaacggcgttatttgttgactttttccgccgtttttgatatactaacggtaggttgatagctgatatattttcatcggcggaacccgcttcgcgtctgctctcccaagcaaacgcggggcggtttttctttatccagttttcacgacggcgggggttcagacctccgccgctttgtctttgtcttcctgcgcgatctgcgccgcgtcctgcttcgacgtgaacagagaagccacagccgcgcccagcgcttcgccccaaacttccacggggtattcattcagggcattcaaaattctgtcgcttgcgataagaacaagctgtgcgcgatcctcttcggcgacttcaacgtttttctcttcgtcgtcctctccggggacagataccaagatttcggatttcagatagcaaagcgggcgaacgccgatgacgccgtagtaagcgccgtaccagctcaccgcgccagaggaattgacgtagcggacgttgtaagagttggacgcgtcgcaggtccacggggtcaggttccagcaccacgcgtccacgcgtgggataatgccgcggaacattcgatacagcttgtccgacagcaaagcgattttgtcggttgcggttccgtagtcggtcataccatcatcggcggtcaggtcgctttcccaatcgaggaacgccgaacggtccgcgccctctgcaaccagcgcgtcgaggaacgcgccgttcagttcgcggcgtagggaagaagaacgccaatcgttcttgttgccttcgtcgaaagcgcgttcaaagacgggttcggcggaaatcgcaacggttccgtcgcctgcgtacagcttgacccactcaacgccgccgtacaggaagcgcccgcccgtttcgatctgcgaaattttcttcatggtttagtcctcctcatattccggcttgaagccgttcttaatgtccgtgataaggtcccggaccgtccgggaaaggcagtaatagaaaaccgggaggaagagggcgaaaacctctccgccgacggcgaaatagccccggtaggccagcgcacgggccgcaccctcacgaaacagcataattccggcaatcgtcagggccgcatacttcacgatagcccacacggggaccgggcggcgctgggcgattttccgggacttccgccgggcggtcatttgcccggcttcagcggtgattgtgataatctcttgtgtcatttcggttcctccacttcgattcgctccgccgccgcgatcataacggcacgtccgttcttgtccagcagttcaccttgtaccagcaacccggttttgtccggggtcttgcggtaaatcaccgctgttactcgctggtaggtgatgccgttgtaccgtaccgggcgttcgtccatgaaagcccgcttcaaatcagccgttgtcacgggacacaccgcctttccgggaaatctcgtattcggccccgaaacgacggcgcttgcaccgccaacaggtgattttcatattcacgccgccgcggacacgttcaatatcgtgtttcccggctttcttgatttcgaggaagcaaggcaagcagaattgacgtttcatgctgtcaccgcctttatgacccgcaaatagaacgcttccggtgtttcatcgggcggaaccgtcaggctgattttgtggaactgctttcggcacttcgtacactccctgcgttcaatcgcgccaaccgtccaaatgttcacgcttccgccgcttccaaaatggttgttcatttcgccgcagaacgggcaaatctccaacagcccattgtgtacgatctgtccggcgctgtcgtaaataattccgtttgttgcttcttttgcgatgtgcttcccgtttctctccacgttttcaacctccttgtttccaaatcgcttcaacctgcttccggcagtattccgggccgttcaggttgacccaatcactgataatggcgcggtcttcgtcttcacggtgtttgtcgatagccttgaagttctcttgcagggtgtccgggtcaaagtatttcacgcttgaacccgtaccgttggccagaaccacgcgaacagcaatacaagccgcgtccgcgcaaatttcgatacgcaggtttccaaactccatgaagtacgcgccgacgaatgacgtacttttcgtcagaccgcgggcagtcccgaactcctgcattgcaagggtgcgggccgtcttcgccgtcagcttgcccccgccgtggcactgtttctttttcgtcatgttgtttcctcccgctcgaacctgattttcatttgcgctgggcaaaggtccacttccgggcgacgggtccccgtccatcgcaggcccccggcttgtccaacgcatttccagccagcggcccgcaggcttgcgccgttctctgtgtccagaatataggtgactactcgtttatagcccatcgcccgcgccgctctccatgccgcggcgtaaagcattgaacaggcgttgcgggttccgtccgtgcaaagtcggttgacctccaatgtccaaccgtcgtcaaggtggcgcgatacaggacggcccacaatggcaacccctacgattttttcgccgtcagatagcccaatggaaaacttatgccccacggttgccccgtggtgtcggtggttttgctcgacaaacgcgtttgcttctctaagcgtcatcggtacgatttcaagcacgttgcgttccctcgctctcctgtgacagccaccaaagcggattgttccgcttgtcctcatacgggcaagggctaccatcgtcacaactgactttcccgcacccggcacaatacttccgctggaattcttcgtcccacggcgcttcaatgacgggcaggccccgcaagaaagcgcccagcgtttccgggttcttcgcaatttcttcaaaattgttcaccgcgaaacctcctttacgaattgaccgcggatttgccgcggcgtttgaagttctcttgcacgcgctgttgtgcaagaacggggttgtatgctctccgctggttgcggtcaagcccgcccgtttcgccgcgcttcaactcccggtagacggtagccgttgccatacccagcccatcggcgatgtctgccacccggtcgccgttcaggtatcgtgtggaaatctccttgcggtcctgaaaatctatgtatctgtactgccgcaccatttcaccccgtttctattgtgttttagctctgttgatggtaaaaaaataaatgcgatagaacgcgtacccgtcattcgacgtggtatttgttctttcgcatttaatattacaagccgccggtgcagggaaacagcagctttcctattgacacagtaggcattccccgttatacttataactaagcgaaaaactgcacgaaagggagaaaaaacttgctcaatcaattttcgagaaccgagctgctgcttggcaagcagggaatggagcgcctgtacaacgcgcgtgttgcggtattcggcatcggcggtgtaggcggctacacggtagaggcgctagcgcgttcgggtgtcggcacacttgacctcatcgacgatgataaggtgtgcctgaccaacatcaatcgccagatcatcgctacccgcaggacggtcggtcagtacaaagtagaggccgctgccgagcgtattcacgatatcaatccggactgcaaggtcaacgtttacaaaaccttttacacgcctgagaccgcttctcagttcgatttcacccagtatgactacgttgtagatgcgatcgacaccgtaaccggcaagctcgagctgatcgagcaggcaaccaaggccggtacgcgcatcatcagctgcatgggggcgggcaacaagattcacgctgacaagctggaagtgacggatatttataagacctccggctgtccactcgcgcgtgttatgcgctacgagctgcgcaagcgccgtatccgtaagctcaaggttgtttactccaaagagcctgccatgacgccaatcgacgatatggcgatcagctgccgccagaactgtatctgcccaccgggcaccgcgcgcaagtgcacccagcgcaggcaggttccgggcagcactgcgtttgtgcctgctgttgcgggtcttatcattgcaggcgaagttgttaaggacctgaccggcgtggagaataaaggataacacaggcaaaaaccgtcatctcaaatgcagagatgacggtttttttactctttgacagtatttgcagccaatgccgcgtcaaactccggccagcagcgcttgaggatagccggtttgccctcggcgttgataaagcagtggcggctgtcgccggtacagcgtagcgtgccggttgccttgtcgtagacatcatagtgcagcgtcatgcgcacgccgttgtactgcgtgatagatgcttcgattcgcacggtttcgccgaatttcgacatggttttgtactggcaggagacctccagcaccggaccgctgtaaccggcctcttcaatgcggtcatagccaaagccgagctgctcgagcaggtccacgcgcgcctcctcgaaccagcggatgtagttcgagtggtggacgatgcccatgccgtcggtttcgtagtattggactttgtggtcgtagggaaccatctaaaaaccttctttcaattagaaatcagttcttctaattagtaatgagtaattagtagttagtaattaagtatacttgcacccgtgaacagtgaaagcgccctctccgagggcgctttctgctgaaacgtttacttaaagtatttcacgccgtttgcaaacagcggctgatacttttcgccgtagatattcttgccgacgaacgggctgtaacgctcggtgtggcccatcttgccgaggacacgaccgtccggtgaggtgatgccctcgatggcgcacatggagccgttcgggttccacgcgatatccatggacggatcaccgttcagatcggtgtactggaacgctacctgaccgttcttaatcaggtcgtcaatgacgtgctgcggcgctacgaagcgaccctcaccgtgcgagaacgcgatggaatgcaggtcaccgacgttgcaggaggacagccacgggctcttcacagaggctacgcgagtggtggcgtagcggctctggtggcggccgatgaggttgaaggtcagcgtcgggtcgtcaccggtcatctcgtcacggatttcgccgtagggaaccagacccagcttgatgagcgcctggaagccgttgcagatgccgagcatcaggccgtcgcgcttgttcagcagctcgtggatgctatccttgatgcctgcgtcacgcaggaaggacgcaatgaacttaccggaaccgtccggctcgtcaccgccagagaagccgcccggcaggataaccatctgcgccttgcggatagagttttcgagctgctctgcgctctcacggagggcatccgcggagaagttgcggacaacgacaatctcagccgcgccgcctgcattctcgaccgcacgggcggtgtcgtactcgcagttggtgcccgggaacaccgggataacggccagcggctttgcgctcttgaccgccggagcggcagcattgcgctcggtgaaggaaaccttggtcagatgctcgtcggaagcagccgccttggtcgggaacacgctctcgagcttgccctcgaaggcattcgtcagctcgtcgagcgttacggactcaccggcaaccgtgatcttctcatcgtcggtggtatagccgaccagccagtaagccgggagttcggatgcggcttcgatcaggatgccgccgaagttcttgagatacagcgcgtcagacgggaaggaatcgtccatcttaaagcctaccttgttaccgagcgccatcttgcaaacaccctcggcaataccgccggtggacagcgcccacgcggaaaccgccttgccggacgcaatcaggtttgcaacctcgttccacatgaacttgagtgtggtgtaatccggcgtgccgtcctgattgtacggtgcatcgaagaagtaaaccggatgacctgccgccttgaactcaggagagatgaggcgggaagcgtcctgcggtgcgattgcgaaggaaaccagcgtgggcggtacgtccatatcgtcgaacgagccggacatggagtccttgccgccgatggctgccagacacaggttctcctgtgcggtgtacgcgccgagcagagcggagagcggcttgccgaagcgcttcgggtccttgccgagacgctcgaaatactcctggaaggtgaggtaagcggtctcaaagtcacagcccgctgcgaccagctttgccacggactcgattaccgcggaagaagcgccgagatacgggttctgctcggtgaaatatgggtcaaagccgaacgccataacggagacggtctcgcactgaccgttcagggccggcatagtagccgccataacctgcgtcggggtcagctgatacttgccgccgaacggcatgaataccgagcttgcgccgatggagccgtcgaaacgctcaaccagaccgcgctcgaggcagatgccgagggtagaggcgtggttcagcagcttttccttctcggaattgcctgccggagcgcaggagatggacggagtcggcagtgcgccaacctctgcgtcaacgtgcttggagcagccgttggtgttgaggaaatcgcgggaaacatcgacaatcttgacgccgttccaggtcatgcacaggcggttcttgtcggtaacggttgcgacaacaacagcctcgatattctccttggcagctgcggcaataaaggcgtctacgtcctttgcacggacaacgacagccatgcgctcctgcgactcggagatggccagctcggtgccgtccagaccgtcgtacttcttcggtacggcgttcaggtcaatgtccagaccgtcagccagctcgccgatggcaacggatacaccgcccgcaccgaagtcgttgcagcggcgaatcatgcgggtgacattgccgtcgcggaacaggcgctgaatcttgcgctcttccggcggattgcccttctggacctctgcgccgcaggtctcgagggattcctcggtgtgcttcttggaggagccggttgcaccgccgcagccgtcgcggccggtcttgccgccgagcaggatgacgatgtcgcccggctcgggtacctcgcggatgacgttctccagcggagctgcaccgactaccgcgccgatctccatgcgctttgcaacataacccgggtgataaatctcgtgtacgaggccggtagcaaggccaatctggttgccgtaggaggagtagcccgcagcagcggtctggcacagcttgcgctgcggcagcttgtgttcgagggtctcagacagcggtacggtcgggtcacccgcaccggtcacgcgcatcgcctgataaacgtaggagcgaccggacagcgggtcgcggatcgcaccgccgaggcaggtagccgcgccgccgaacggctcgatctcggtcgggtggttgtgggtctcgttcttgaacatgagcagccagtcctcgtagtggccgttcacgagtgccttcaccttaatggagcaggcgttgatctcctcggactcgtcgatattcttcaggtagccgcgctttttgagcaccttagccgcaatcgtacccatgtccatcagcgttaccggacgcttggcggccttttcctcgccgtagacctccacgcgggcggccatgtagcggtcaaatgcatcctgcaccatctgatcctcgaacttcacatcgtcgatctgggtgaggaaggtggtgtggcggcagtggtcagaccagtaagtatcgaccatgcggacctcggtgatggtcgggtcgcgcttctcggtgtcgcggaagtaggtctgcaggaacttgaggtcgtcaaggtccatcgcaagacccatgtggtgcagcaggtcagagagcgcactctcgtccatgtgggtgaagccgacaacagacgcaacgctggtcgggatagcgtattctaccttgagggtagcaggcttgtccatcgaagcctcgcgggtgtccacggggttgatcaggtagccgcgaatcttgtccatgtcctcagcggtgagttcgccttccagaacgtagattttagcagcggcaacggtcgggcgttcgccgccggtgagcagctggatgcactgtgcgcaggaatcggcgcgctgatcgaactgaccgggcagcggctctaccgcaaggatggtgtgagcgccttccggacggggaaagtcctcgtcgtagcacacatcagccataggctcggagaatacgatgccctttgccttctcgtaggtctcaggtgcaagtccctctgcgtcgtagcggcagagatagcgcacatgagtcaggtttttgatttccaacaggtcgtgcaggctggagaacaggctgcgtgcttcgacatcgaagccgttttttttctcggaataacaacgattgacgctcatgatcgtgttcgctcctttattgcatgatacttctattctacctttttcacgcagataaatcaatcggtgagggcgacaaaatattgttgatttcgatggagaagttttctataccgttagaacaaattagtaatcaggaattagcaaacggtaattgacggtgtggtgcagccttcttctgggtatagctcattaaaaatggaaaccgcaggatgtgacaagatgcagcagtgtgaagaagatgaaaacgttatgttatctccactccacactctttcctttcaatttccaaagaggtgtgatataatgtaagtcaagaggagggcgaccgtgcatgccgccctcgtattcaaaaagacggcgccgtgcaaaccggttgagcatacaggcgcgtctggtatcaaattatgccgcggaatactctgcggttacaggaggaactgtcatggaaatcaagctctcaccgtctattctgtccgcagattttgcaaatcttgcacgcgatattaaaattgccaccgatgccggtgcggaatatgttcacgttgacgttatggacggtcacttcgtgccgaatatcaccatcggcgctccggtggttaaggcgctgcgcaaggcaaccgacaaggtgctcgatgtacatctgatgatctcggacccggaccagtatctggatgacttcatcaaggccggctcggatatcatcaccgtacactacgagtccaacggtgatacgctcgagcagctgaagaaaatccgcgcagccggtgtcaaggcagcctgcgttatcaagccgaaaacccccgctgaggtgctgttcccgctgctgccgtattgcgatatggtgctcatcatgaccgttgagccgggctttggcggtcagggctttatcccggagtgcatggacaaaatcaaggctgtccgcacggaaatccagaagaatggctataagtgcgagctggagattgacggcggtgcaaagctgaacaataccgccgacatcgtagccgccggtgcagacgttatcgtagcaggttctgccgtgttcggcggtgacattgcagcgaatgtcaagggcttccacgaggtattcaaggaaggcgcagccaaggcagcctggagcaagtaatcatataagtgtgaacaacccccaatcgttagtctgtctgaccgttgggggttttctaatagagatgagggataaaatgaacgaactgacaaagcgaatcgtttcgtgtgtgctgctgttgataatcggacttgggtgttttttcggcatttcgggatggcagtcttcaccggagacgcaccggacgagcattgaatatttaaacgaaaagcaggcgactgtgatgaagctgactgcggcttccacggcagcatctgcagctgtttcggctctgccgggagacacgggcagcgccatcgcagaaaagctggctgatctcacgtcggactttctgatcgtactgtgcgccattatgctggagaaatacctgctcaccattaccggatacgcggtttttcggtttgttttaccggcagtgtgcgtgctgctcatcgtccggcagttccgcagcagcgagattctggcgaagctcgcattcaagctggcgctgttcggcatggcggtttggcttgccgttccgggcggcatcacagtatcgcgcatgatcgaggccacctatgaaacctcgctgtcgcagaccattgaggacgcgcaaagtgcagcggatgctattgataccagtacgggttcggactcggattcggacagcgaaaagagcagtttctggtcgggtattacgtcatcggtgcagaatgcggtctccggcgtgacggagaagtttgaaaaactgctcagcaatgtcatggaggcactcgctgtgctgatcgttacctcgtgtgtgctgccggtgctcgtgctgctgttcctgctgtggattgtgaaaatgctcaccgggattgacttcaatctgccgaagcggaaatcaacggagtaattaagagtggagagtgaagataacgtagcgatttacccttcttcacatgattctatcttattattaaaggtataccatagggtacgttggcttggcacatcgcctgtaattcatctgcatagatctaaagggagtgaatttcaaatattgtcaggcctgcaaggtcaatccgcctcaaaccggcagctgtaagaccttgttaaaataataaaaccgcctgaaaaggcggttttggttttattgtgtattatctatggtaaattaatgttgcgggtgttgctttacgctgcgtttcatctggtacatgcacacgcccgcgtttacaacagtcgccagcaggaacagtacgactgcgcagaaccgaatagcgaacgatgtatccagaagggcgctgaaatcctgtgcatatacgcgaacattgtactcgaaaatctgtccgagcaacgccagtgagcacaaacccatactgaccgctgcaaacggcagcgcgttttttcgtctggccagtgcaatgagcggcagtacaagtgaaagtataccgcaggtcaggctccccacagagcacatcaccgagattgaaattgtaggggacattttttgtctcctccttcctttgcgaacagtataacacattatgggtggaatggaaaggacaatattacgcagccaataaaccctcacgttaattcctaatttagcattgacagaatcgcccacagaagatatgctaatcctaagaaattaacacactattaaaaagaggtacgccatggcagacacaggaaaactcaagcgggaaaacacagctccgcttcggcaggagatgcagcatggcctgcaggcaagaacgatcttgcgcggttggcgcatctcagctttccgaccgtcagccgcattgtggatgagatggtcgagcgcggagaagcgaaagaaatcggcacagccgcttccaccggcggacgctgcgccatgcaataccggctgaacccacagtacaggctgttcctgtgcctgcggctggagcaggacacgctgcactggcttgtgtgtgacctcgacggcacaccgctcgaacaggaacagcagacctgctccggcgatgtgcgcgaacttctcgatacgcttctgatgcgtgttagggtgcgttacccgcggcttgcagcggtggtgctcggctttgccgacggcatcgtcaccgagagtttcggctaccctgagctgcggggcgtaagccttagtgcgtatcttcacgataaaaccggcctgccgtgcatggcggcccgcgatatgcaggttgtggccgcaggctatgcggcgcagtacacgcccgcaccgaaagccgccgtgtgtatttacatcggcaagctgggtgcaggcgcaggtatcgtgctggacggaaaggtctggggcggtgccgcaggctttgccggcgaattacactatctgccgattaaacacaatctcgaatacgcgcagaatcactttgcaggcgcggatatgagcgactatttcaccaaagtcatctgcagctgtgcggcgctcatcaatccggacagggtggtgctgtacgctgacccgcgtctggcagataaggcatcgcaaatccgcgtaagctgtgcgcaggcgctgccggagcaggccatgccggtgatagagctgtcccggtccttcgagcaggattacacccgagggttatttaccttggcgaaaaagatggaggaaaccacatgaaatactttgtttttgacattgacggcacgctgatcgactcctcgaaggtagaccagtgggcgatgcgcaccgcacttgccgagtttggctatgagttcacctacgagcagctgagtttctccttcggtatgccgggcagacgcgcattggcgaaattaagcattccagccgagcaggtcgagccgatcatggcgcgctgggaagcgctggcgtatgaccggctggacgaaatcccgatgtacgacggcatccccgaggtgatagccgaactgcggaacggcggatgtcagtgcggtattgttacctcgcgcacgcgcctgcagcttgagcaaggcatcaagccgattggcttcacgccatggtttgatgagattatctgcgccgatgacgtggagcatcctaagcctgcgccggacgctctgctcgagtgtctgcgacggttcggctgtaaacccgaggacgccgtctatatcggcgacagcgagtacgatatgcagtgcgccaagagcgccggcgtcaagagtgtcctcgctctgtggggatgctccgaggcggagaagctaacgtccgacctcaggtttgagcatccggcagagattttaacattacggtgaaaataatggagaatggaaaatgaatgagtccgcccgatggacggtaattaaataatcgcgcaatgcgcgatacctcgtcgcagcgcggacgaaactcacgcaaggatagcgacattctcaattcgaataagaaaagcctctctcgcaacgagagaggctttctcttattcgctcttatgcagcaaatccataaattcctcgccggtgatggtttccttctccagcaggaaatgcgcgagccggtgcagggcatccatattattctgcaggatgccgatggccttctcatgcgcggtcttgacggtggcaatcacttcctcgtcaatcttcgccgcggtctccgccgagcaggcgagagcggtatcacccgacaaatactgattcgttacggtctcgagagcaaccatatcgaacttgcgactcatgccgtagcgcgtgatcatcgagcgtgtcagcttggtggcctgctcgatgtcattagatgcaccggtcgtaatcgagccgaaaatcaactcctcggctgcacggccgccggtgagcgttgccaccttgttcagcagctcgtccttgctcatcagattgtgctcgccctcatccacctgcatggtgtagccgagtgcacccgaggtgcgcggcacaatggtaatcttggtgacaggcgcggagtcggtctgcttggcagccaccagtgcgtgaccgatctcgtggtacgcaacaatctccttctccttggcgctgagtacggcgttcttgcgctgcgcaccggcaatgacggtctcgacgctctcatccagatcggcctgaatgacactgttgcgtccaagacgaacggcacgcagagccgcctcgttgatgatgttggcgaggtcagcaccggacgcacccgaagttgcacgggcaatcgagttaaagtcgatattgccggacatatgaacatccttagcgtgcaccttcaaaattgcgatacgaccctgcagatcaggcagctgcaccggaatgcggcggtcaaaacggcccggacgcagcagagccgggtcaagcgactcgggacggttggtcgctgccagaataacaacacccttggtgccgtcaaagccgtccatctcggtcagcaactggttgagcgtctgctcgcgctcatcgttgccgcccatgcctgcgccgtcacgctttttaccgatggtatcaatctcgtcaatgaacacgatgcacggtgctttttcgctggcttgcttgaacagatcgcgcaccttggccgcgcccatgccgacgaacatttcgacgaactccgagccggaaatcgagaagaacggtacatgcgcctcgcccgcaacggccttggccagcagcgttttgccggtgcccggagggccgaccagcagtgcgcccttcggcagctttgcaccgatggaggcgtacttgttcgggttgtgcaggaagtccacgatctcggtgagggcctccttggcctcatcctgaccggcgacatcggcaaaggtcttgccggtctcggtctcggcgtaaatcttggcattggatttgccgaagctcatcatgttgccgcccatgttcttcatcatctttttctgcagccactgaccgaccgcgataatgagcacaattggcacaacgtagctgatgagcatgctcagcaggggagaggcctgggtcgggatctcagcggcaaacttgacattggcccccagcagacggccgaccagctcgtcatccgggaaaataccggtcttgtagagtgcatccttgcccttgtcgttcttggcctcgaaggtgatctcctggttctgcttgtcataagcgatggtctcgacctgacccttgtccaccatggagatgaactcgtcatagccgacttcggtcacctgtcgctgcagcaagctcggaaacagcagccagttgagcatcataagcacgagcagcatgacagcataatagaagatcagcggttttttgggatttttcgcccctttggggttgttattcatgtgagtttcgtcctttcgagtaaatcgttgaggtttcgctgcattttctgcatcacactgcacagggtctgcatttcctgctcggagataccctgctgcagtgtcagcgcaaaggtttcacagcggtgatggagcgttttggcggcagcgtgtccttcatcagacaggtgcagatgcaccaaacggcggtcgttctcgtcgcgcacgcagtagagcaggccgcgcttctgcagtccgtctacgctgcgcgtcaccagcggcttggaaacgttccacgcctgtgcaatgacagttgcggtgtcctgctcgggcgcgttgcggtacagaaacagcagcacgaacatctcatttggcgtaaagccgcagctttcggtcagctcacgaaagcagctgcggtacagctgacccgcgtggaacgcatcggcggcaaaatcgtggggagagccggacatgcggtgtcctcctttcggcaaacggtttacttgtaaactataatagaccgaaagcgggcgaacgtcaatcgttcaaatgtgaacattctgaaaattcagacattctcaattcttcatccgaaacaaaaaagacgccgagaaccctctcagcgtctttctgcagtttacttcatggtaccgcgggtgccccagttggagaactcggtgtacgtcaggtaaatgctgtcatcgtgcagaccggtgtgcagctcgacagcatcaaacagtgcctcggtcagcgccttcttgttctcaaactcggtcgaaccgtagcagcgaacatcaacgtacgccagcttgcgcttctcgcctgcaaagtacatggtgtggttgtcggagatgtcaaccatcagagcagcctcggtcttgcccggaatcagggaaatcttctggccgatggtcttcttcagctcgtccttctgctcgtcggacagggccttggaagtggtaacagcaatatacggcatgggtatatccttctttctttgggattgggcagtacggattgcccgtggtttattttattgtagcacatcgaccgctgtttgcaatatcgtaatcctgcataatttgcagttgggaaaggcattttaaaatcagcagtttttgacagtgtatttttaaatgaactgtgaactttatcaaaaacaggtgcacaataagtggatttgtggtatagtattaacagtgaagaagtacagtccatgatcgggtgttgcatatgaatatcaagtgtacgcaaaatatttacaaaagtgccaatggtgtttccaatgtcacctattatattcttgttcccgaaggagtagaggtgcgcggtatcgtacagctgtctcacggcatgtgcgagtatttttcgcgctataccgcatttgcgaagtatctctgcggactgggcttcattgtctgcggaaacgatcatatcggacacggagcatcggtctcacgcacggcggatctcggtttttttgccgcccgcgacggttggaagtatcttgttgaggatgtcaagcacctgaccgacctgatgcagcgccgctatcccgacctgccgtatttcctgctcgggcactcgatgggttcgctgatcgcacggctgtacctgctcgattacggagagaagctgtctggatgcattcttattggaacagtcggcccgatcgctgcctccggcagcatcgtacatcttgcggattcggtagcgcgctcgcgcggcatcacctatcgcagcggactgctgtccaatctggtgttcaagggcttcaacaggaaaatcaagcagccgaaaaccgtgtttgactggctcagccgcgatgaggcggtcgtgtcgctctatcagtcggatgaaaagtgcaatttcgtgtttaccgcgaccggattccgcgacctgtttacgctcatcaccaaggcgaacaatccggtgaccttccgaaaaacaccgaaggacctgccgctgctgttcatctcgggtgataaggacccggtcgggcggtacggtgagggtgtgcgccgtacggtcaatctgtatcgcggcaacggcgtgaagaatatcgaggtcatcttttataaggatgcgcgccacgaggtgctcaacgagcttgacagacttgaaaccttcggagatatttcccgttggctggagacacaccttgccgcaagagctgcaaggcaggctgtcgagcaggagccggaaacggcagcggaataaaaataaaacctctctcaaaacgcttgagagaggttttttgtgctttttaggcgcgggaaaccgccttgctatgctgtctgcccttgaaataccgtgcattgagcactgccgagacaacgagcagcacgcctgcgatcagcagggtagcaaaaccccagcggatacccgcacggttggcagcgatgccgatcgcagccggagccatagctgcgccgaagccgttaagcgtaacataaatgcccatggatgccggatagcgcgagaacaaatctccggcattggccaccgttgtgccgtacatgccggacatgcacagacccagaccgaccgtcgcaatggtgagaatcggcagcgtggttccggtgacaagcagcacgaggaacgccgccacgccgaagcacatgaccgtgatcatctgccacggacggaacttcgcagcgatcacgctgcacgagaagcggccaatcaacagcgaaacccacagcagggaagtgatgatctgcgcagcgtctgcggcgagcacgccggaatcaatgtaaaagctggtcagccagcccatcatggaagcctcaacagcctcgtagaaaaagcagagcgctgtgcacagccagaacagcttttcgcggaaaaagccgtaatcggttgcggatttctgctcggttttcgtggatttatcgtcatccatcttcataaacagaccgaagataaacgaagccgtcagcagcacaatggaaatctcgagcgcaagacgccagccgttgtcaccgcccagcttatggcaggcgagtacggccagcggcgccacacacgcgccgaacgcatacgccgcgtgcatcatgttgagcggggtcgcgctgccgttcgcgtattcgctcattacgcggttgttgtaatccgtgatagcgcccttggaaatgccggtcaggaacatggccgccagcagccagaccggcgagccgttggtcagcagcatgacaaagccgaccgcaaatacataatacaggatgaggtacgcgcgcttgagtccccatttgatggcagccagaccggacagcaggccgatgccgagatagccgatcgactgcgcggacagcagcgtaccgccgatctggtaatccagcgcgtaggccgcgcgtaaatccggcagcacggagccgagcatgatggagctcagtccctgtgcgaaataaacaaaaaacagttccgcgacaacatagcgtttgctgcggttcagggaagataaaaatgctttcattgatgtgtcccttcaatttgtgtggaatatgcggttttctttttttgaccgcgattttagtataatctcctgcggtgcgatgtgctactaaattcttgcgatttacatctgcgaaaagatagcgtgtttctgtgaaaaactgctgaaacaggctatagtagtgaaatcctgtgcaggggtgctgcacagcttttatacaatcttgcgatgatggcgcaaagaaacagcgaaccgttgcggttcgctgtctgcaaatttgcttgtttagatgcggcaggcttcaagaagctcgttcttgcagctccacagctttttggagagatccacgaagtaggtctgcggattctcgaaacgcttgatctgatcccacagagtatcaacctcacggatgcagtacttgcggatgtcctcaacatccgggctgttgtaaacgcatttgccgtgcttgaatagctgtacgcgcagcggacgaaccgtataatcggtaacaatacgctgcttccaggtgtagacaggatggaacagcacatacggcagggaagcatcgatctgctcgtcgtgtacggtgagcacatcgccaagtgccttgccggtcttgttgtcgaacaggcggtatacctgcttgaagtgcggcgtggtgatcttctcgacgttctcggaaaccttgatcttcgggatgatctcgccgttttcgtcctcaacggcagccagcttgtatacgccgccgaataccggctcggacttggaggtgatgagccgctcgccgatgccgaacgagtctacgcgggcaccctgcacgagcaggtcgcgtaccagatactcatcgagcgaattggacgccatgatctgcatatcctcaaagccggcggcatcgagcattttgcgggcctcgatagaaaggtaagcgatatcgccggaatccagacggatgccgcgtgcgcggatgcccttctccgcttccagttccttggcaacgcggattgcattcggcacaccggacttgagtacattataagtgtcaaccaggaatacgcagttatccggataaatatccgcataagccttgaaggcttcgtactcgctgtcaaacatctgcacccaggagtgtgccatcgtgccgccggccggaatcttgtagtcacggtcggacagaacgcaggcggtaccctgacagccgccgatgtaggcagcgcgggcaccgaggatagcgccgtcgtagccctgtgcacggcgggagccgaactcgagcaccgtacgaccttctgccgcacgcgtgatgcggttcgccttggtggcgatcagggtctggtggttgatggtcagcaggatcatggtttcgacaaactgtgcctggatcatcggaccggccaccgttacgagaggctcgccaggaaataccggcgtaccctcgggtacggcccatacgtcgcattcaaactcaaaatcgcgcagataattgaggaaggactccgagaagcacttgcggctgcgaagatatgcaatatcctcctcggaaaaatgcaggttgttgaagtattcaatcagctgttccacgcctgccatgatggcatatccgccgccgtccggtacacggcggaagaacatatcgaagtatgcgcggcggttgccgatacccttttcgaagtatccgttcgccatcgtaaactcgtaaaagtcagtgagcatggttaaatttctttcggtcattgcgaaaaacgcccctttgcgcaccattttttgtgcgcttttattcattccgtgcaatctgtcttgacacagtgcatttataatataatagtacgtttttacagaaagtgcaagcattatttatcaaatctaaattcatagtatgcataaatatacaatcgagaaaataattataaattttgcttgccaaatgagtatggcggtagtataataagaccatcgaaaaaaacgcagaatgcgaggtcgaaaaacatggaaaagaaatataacaaagttgttctggcatattccggcggtctggatacttcggtactcatcccgtggctgaaggagcattatggctgcgaagtcatcgcggtttccggcaatgtcggtcagggcaccgagctggacggtctggaggagaaggcgcttaagaccggcgcgtccaagctgtacatcgaggatctgaccaaggacttcgttgatgactacatcatcccgaccatgaaggcgggcgcaacctacgagcagtacctgctgggtacctcgttcgctcgtccgatcatcgcaaagcgtattgttgatatcgcactgaaggaaggtgctgacgcaatctgccacggctgtaccggcaagggcaacgatcaggttcgtttcgagctggctattcacgcatttgcaccgcagatggatattatcgctccgtggcgtttctgggagctgaacagccgtgagaaggagatcgagtatgcggaagcacacaacattccgctgaagatcaacaaggagaccaactactccaaggataagaacctgtggcacctcagccatgagggtctggacctcgagctgccgtccaacgaagcaccgatcaacaagccgggtttcctcgagctgggtgtttctccggaaatggctccggacaagccgacctatgttaccatccacttcgagaagggcgttccgaccgcagttgacggcgagaagctcgagtccgttgccctgatcgagaagctgaacaagctgggcggcgagaacggcatcggtattcttgatatcgttgagaaccgtctggtcggcatgaagagccgcggtgtttatgagactccgggcggtgcgatcctgtatgcagcacatgcaaagctggaggagatcaccctcgacaaggaaacctcgcactacaagaatcaggttgctctcaagttcggcgagctggtttacaacggccagtggtacacgccgcttcgcaaggcgctctccgcatttgttgactccacccaggagaccgttaccggcgatgttaagctgaagctgtacaagggcaacatcatcccggcttccgtaacctctccgtacagcctgtactctgaggatatggcaacctttaacgaggatgactgctacgatcaggcagattccgcaggcttcatcaacctgttcggcctgccgctcaaggttcgtgccctgaacgatcagatcctgtacaagaagactggtgagcatttcccgtctgttgaaaagtaagtaaaagaaatcgtagggcggcacgcccgttgtgtgccgccctatgagtgttttgtgaggtaacataaatatggcaaaattatgggcaggacgtttccagaaggaaaccgatctggtggtaaacgatttcaactcttccatcctgtttgactgccgtttatataaggaagatatcaccggatctatcgcgcacgctaccatgctgggcaagcagggtatcatcgaggagcatgaggccgaaaagatcgtcgaaggtctgaaggacatcctcaaggatatcgaggacggcaaggttgagttctcgctcgattacgaggacatccacatgaacgtcgagcagctgctgaccgagcgcatcggtgataccggcaagcgtctgcacaccggccgttcgagaaacgatcaggttgcactcgatatgcgtctgtacgtcaagaaggagatcaaggagatcatcaagctgattcttggctttatgaaggcgctgactgtaaagagccgtgagaatcttgatgcggttatgccgggctacacccatctgcagcgcgcacagccgacgacctttgcacattatatgatggcgtatgccaacatgctcaagcgcgacgtatcccgcctgcaggactgctacgagcgcatggacgaaatgccgctcggctcgggcgcactggcttcgaccacatatcccatcgaccgtgacttcgttcgtgagcagcttggctttgcccgcctgaccgataactcgctcgacggcgtatccgaccgtgactactgtgtggagctgctctccgcgctgtccatcctgatgatgcacctgtcccgcctgtccgaggaaattatttcgtggtgctcctgggagttcaagttcgttgagctggacgatgcgtactccaccggctcgtccatcatgccgcagaagaagaacccggacgtctgcgagctgatccgcggcaagaccggccgtgtttatggtgcgctgactaccatgctgaccgtgctcaagggtctgccgctggcgtataacaaggatatgcaggaggacaaggaggctgtattcggtgcaattgacacggtaaagcagtgccttgaggtattcactccgatgttctccaccatgacgctccgccgcgacaacatgcgcaaggcagcttcccgcggcttcatcaacgcgaccgactgcgccgactacctgaccaagaagggcgttccgttccgcgatgcgtacaagacggtcggccgtctggtcaaccagtgcatcaaggccgatgagacccttgagaccatgaccatgcgtgactttgcagcaatttccaacaagttcggcgacgacgtatacgacgcactcgacctgcgcacctgtgttgccgagcgtaaggtcatcggcggtccggctccgcaggaagtaacccgccagattgataaaattgataagttcatcgcggaggttgaggacgatgaagcctaaaatctacatcgacggcaaggaaggcacgaccggtctgcagatttatgagcgtctcggcggccgcgacgatatcgagctgctgctcatcgacgaggacaagcgcaaggacatcgaggagcgccgcaagttcctcaatgcagccgacattgcgtttctgtgcctgccggatgcggcggcacgcgaggccgtttcgctcatcgagaacaacacgacccgcgttattgacgcatcgaccgcgcaccgcaccgacccggattgggactacggctttgccgagctttccaaggcgcaccgcgaagccatcaagaactctaagcgtgtggctaatccgggctgccacgcgagcggatttatttcctcggtttacccgctggtagcaaacggcatcattgccgaggacaccgcgcttacctgtgcttcactgaccggttactccggcggcggcaagaagatgatcgcggagtatcaggacgagaaccgcgatccgcggcacgattctgagcgcatttacggcctaaacctgcatcataagcacctgccggagatgggctacatctgcggtctgacgcaggcgccggtgttcgttccgatcgtcggcgacttctacaagggcatggcgactaccgttatgctcccgggcgtagacgcacaccttgtgcatagaacgcttgccaagcactacgagggtcagcagcttgtcaccgtggcgccgttcggcggggaagagccgatgatctacgccaacacgctggccggtcacgacagcttaaagctcattgtctgcggccacgaagagcagacgatcgtcaccgcgctgtttgacaatctcggcaagggtgcttcgggcgctgccgtgcagaatatgaatatcatgctcggtctggatgaaacgaccggcttaaacctctgatttcagcaggaggaaacagttatgaagattatcgaaggcggcgtttgtgccgcaaagggcttcaaggcgggcagcgtgcgctgcggcgtcaaggaaagccgaaccaatgatgataccgcgatcattttcagcgaatgcgaatgtaccgcggctgccacttacacgatgaatcgcgttaaggcggctccgctgtacgttaccatggagcacctcgaggatggcgtagcacgcgctatcgttgctaatgcaggcaacgcgaacgcctgtgcgccggacggcatggagaacgcccgccgcatggcgcaggcagccgcaaagctgctcggcgtagccgaaaccgacgttgccgttgcatccaccggtgttatcggccagcgcctgaacatcgagtgcatcgaggagcaccttccggagcttaaactggaggacaatgcctccgaaaaggccaaccgtgccatcatgaccaccgacaccaagcccaagacggcggctgtcgagttcaccatcggcggcaagacctgccgcatcggcggcatctgcaagggcagcggcatgattcatccgaacatgggcaccatgctgtccttcatcacgaccgactgcgctatcacgcacgaaatgctgaccgacgccctgcaggagaacgtcaagaagacctacaaccgcgtaacggttgacggcgacacctccaccaacgatatgtgcatcgtgctcgcaaacggcatggccggcaacacgctcatcgagtggcaggacgaggaatatcaggcgttctgcaaggcgctgaacgaggtgaacacccgtctggcacgccagattgctgcagacggcgaaggcgcaaccaagctggttacctgcaccgttaagaactcccgctccgaggaggcagctgagcggctgtccaaggccgttgttggctccaacctcgtcaaggcggccatgttcggcgcagatgccaactggggccgcgtgctgtgcgcgatgggctactccaaggcaccgttccgtccggagtacgtttccgtggcgtttgagtccgcagcgggcagcgtagcggtctgcgacaagggtgctgctctggattttgatgaagaactggcgaagaaggtgctctccgagagcgaggttaccattgcagttgacgtaaatgagggcgaggacagcgctaccgcatggggctgcgacctgacttacgactacgttaagatcaacggtgattacagaacttgattcttaaaaacgaagaaaactcccgataaaggaacgaattagtatggatactcaacttgatgcggagctgcgcgccaatattctggtcgaagcgcttccgtatattcaggaatattatggtcagaccgttgtcgtaaaatacggcggcaacgcaatgatcaatgaggagctgaaggacgcggtcattcacgatctggtactgctcaatctggtcggcgtcaaggtcgttatcgtacacggcggcggcccggaaatcaatgaaatgctgggaaagatcggcaaggagagcaagtttgtcaacggcctgcgctataccgatcgtgaaaccatggatatcgtccagatggtgctgtgcggcaaggtcaacaaggaccttgtaaccctgatcgagaaggcaggcggccgcggcatcggtctcggcggcatggacggcggcctgtttcaggcgaagcgcctgaccgaccgtgccggcacggattacggctacgtcggcgacattatggacgtagacccggctccggttatcgacgtgctgcagcagggatatatcccggttgtttcgaccgttgcacagggcatcgacgatgaaaccaactacaacatcaacgccgacaccgcagccagcaagctggcagtcgcactcggcgcaaagaagctgatcctgctgaccgacgtgcgcggcctgatgctggatgtcaacgacccggacagtgtcattcaccgcctgaaggtgtccgaggtgcccaagctggtgcgtgacggcgtgatcaagggcggcatgatcccgaaggtagactgctgcgttgaggcagtccgaaagggcgttgagcgtgctaccattctggatggccgtgttaagcattcgatcctgatcgagctgctctccaaggtcggcgcaggcactatgtttcagtaattgagaattgaaaatggagaatggagaatgattcgctccgtatctccggtaaaaggtgataccctatgacttacaatgaattaaaaagcgaagaaaacaaatatgtaatgaacacctacggtcggtttccgattgcgctggaccacggcgagggtgcgactctgtgggacgttgagggaaaaaagtacatcgatcttgcttccggcatcggtgtaaactgtctgggttatgccaatccggcgatcattgacgcaatcgacaagcaggcgcacaagctgatgcatgtttccaacctgttcaccaccgagccgatggttcaggttgccaaaaagctggtagaaaagacgcatctgggcggcaaggtattctttgccaactcgggcgccgaagcaaacgagggtgccatcaagctggcgcgcaagtactcgttcgacaagtacggcgagggccgctacaaggtgctgacgcttatcaactccttccacggccgtaccgtaaccacgctgaaggcaaccggtcaggagcgttttcacaactatttcttcccgtttaccgagggctttgattacgcggttgccaacgacatcaagtcggtgcgcgcaaaggcggacgatatgacctgcgccatcatgatggagctgatccagggtgagggcggtgtcctgccgcttgaccgcgagttcgtcaaggaggtagagaagctctgccgcgagaaggatatgctgctcatcatcgacgaggtgcagactggtatcggccgtaccggcagcctgtttgccttccagcagtacgacatcaagccggacgttgtcactatggcaaagggtcttggcggcggcatgccgatcggcgctgtcatggcggcggatacctgctgcaacgtcctgacgccgggcacgcacgcgaccaccttcggcggtacgccgattgtctgctccgcagcaaacgtcgtgctcgatactgtcggtgacggccagtttctgatgaaagtacgcgaaaagggtgagtacctgcgcaacggcatcctgtcccttggctcgccgaatatcaagggcgtgcgcggcatgggtctcatgctcggcatcatcgttgaggaaggaaagcactccgtgtttgccaataagctgatcgaaaacggcgttctggcgatcaccgccggtaaaaatgccgttcgtctgctcccgccgctcaccatttccaaggaagagatggatgaagcactcgctgtcatggcaaaagtattttgataattagtaattaacgtgattatcgcactggtgcagcagcatccaaataattactaactactaatttacagaaagggtttattacaatgaagcatttactgaagctgcttgactgctccaccgaggagatcatcggtctgctcgatctggcggatcagctcaagtatgagaaaaagcacaacatttcccatcgtcatctggaaggcaagagccttggcatgatcttccagaagtcctccacccgtacccgtgtttctttcgagaccggtatgtatcagctgggcggtcaggcactgttcctgtccaatcgcgaccttcagatcggccgcggcgagccggtacaggacacggcccgtgtgctgagccgctatctggacggcattatgatccgcacctacgagcagaaggaagtagaggatctggcaaactacggctctattccgatcatcaacggtctgactgatttctgccatccgtgtcaggttctggcagacctcatgaccatccgcgagaagtttgccgttcttgagggtctcaagatgtgctacattggcgacggcaacaacatggcaaactcgctgatcgtcggcggcctcaagaccggcatgaaggtttccatcgcaacgccggcggactaccgtccggacgctgaggttatggcattcgcagagccgaacccgaacttcttcatcaccgatgacccgatgaaggctgctgagaacgcagacgttgttatcactgatacatgggcgtctatgggtcaggaagctgagaaggaagtccgcatgaaggcattccagggctatcaggtcaatgatgagctgctggctgctgcaaagccgggctgcatggtgcagcactgcctgccggcatatcgcgagcaggagatcaccaccaaggtgttcgaggagcacgcaaacgaaattttcgaggaagcagaaaaccgcctgcacgcacagaaggccgttatggttactctgatgggcagcaaggaagactgatttctgataaaaagccgcttttcgcaaggaaaggcggctttatgtttttcttgctgaagtgttgacaaatcccttaccggcgactataatagcagtataaataaatcagttctgtttcagggcggagtgaaagtctccaccggcagtatacaggcttcgagcctgatagtctgcgagccgcaaggcatgatgggttagaatcccaaccgacggttatagtccggatgagagaaacagatgtacctatcgctacgtctgtatgcctctggagcaatccgggggcttgttttatttatggaacaggactcctgaaagggagaaaaaacagcaatgacaaaaaccagcaaaatcacctacaccgcaatttttgcggctatcgcaaccgtactgatgtactttgagtttccgattccgttcatgccgccgtttctcaaggtggatctgtccggcgcggtcgtgcttatcggtgcgtttattttcggcatcgctccggcgatcacgatgatcggcatcaaggacattattcatctgacccagacccagaccggcggctccggtgaggtcgcagatttcctgatgctttccacgctcgttgttatcgccgtgctgctgtaccgcggacacaagagccgcaagatggctgtccttggctgtgcagccggatcggtcgctatggcctgtgtcggcatgctgaccaactattttcttatcattccgttttattcgcaggttatgccgttgcaggctatctttgatgcgtgcaatgctatcaacccgtatgtgaccggcatgcagggctatctgctgcttggcgttctgccgttcaatctcatcaaaggcgcaattctgactgcgattaccatgctcgcctacaagaaactgagcgtgttcatcaagtccaagcagatcgaactgcaccactccagacagcgtgtcggataagtaaaaaacgaaggtgctctccatcaaacggagagcacttttttgttcaataattggaaacagtgcggtagcatctatgatttcaacaaagatctgtatacgaattgacaaaatgcgtggccaagattatatcacatgcgtgcatctaatagattcggtccagtcaagatttatgcgcaaaattatttgcaggctccggctgagtgaagtcagccggcaatgaaggcgtcatccagcgccgtcttcaagtgcttcatgtttatatcttttttgctgccccactgcgtgctcgccacatggcgaagccgggcgcagaccagcatcagagcagagttgccgtcaggaaatgttcccaccacacgggtacgccggcggatttcacgattcagctgctcaatcacgttgttggtatggatgcgagtccaatgctcgctgggaaaatcgcagtaggtcagcgtttcctcgataccgtcctcaaccttcttggcagcctccttcagcttcatggcgcgcagttcggcaacgactgctttagccttgtcgcgggatgcctttttgctctcctgtgcgtagattgccttgagcatttttgccacaattttgaccttggatttaggcacaacagagaaaacattgcgatagaaatgcaccgtgcagcgctggtatttgacgtccgggaacacctcgcccacggcctccagcatccccatgcacttgtcgccgacgatgagttttacgccgtccaagccgcgtccgcggagccactggaagaagctgacccagctggccttgtcctccttcatttcctcggcagatcccaaaacctcacgggaaccgtcctcattcacggcgattgccaccagaatcgccacattttcatactctccgccccagttgcggcgcaggtagatgccgtccacgtagacgtatggatagcgtccgtcctgcaaggggcggttccgccagtcctcgatgtgaacgtaggctttcttgttcagcttgctgatggtggcgggcgaaaccttgttgccccacagcgcctcggtgatgtcctccacccggcgcacggagacgcccgccaggtacatctcgatgagggcctcctccacgttgctgcggaccaattctttgatctgccccttgataatttcctcattcagctgtacaattttctcggacatagtttgctgtctcctttcgaatgtttgtgtggtaacttcattctaccagagcctgcaagctatgtctttttttatgcggttttcaatttgcgcaacttattgtaccttatcatatgaatcaggaagaatagcatggattgatggagaaactaaactgtcgggtaaaattaatatacagcgctcgtgtttttcgtcttattattattgctcatcaacggcgcagctctgtggaaagcttcacggtggtttttgcacttatagaatatatatgcgaaacacagataaatgaacgtatagtcattaaacgaaaaaacatcagacgctatatatgaaaatgccataatagagaattagtagtcgtttttaagataataacataaatatgcaaatatgaatattctgccgatgaaaggctcactgtataagcggagtagacacgaagaaacagactaacgactggctgtgcctttatggaagatgctgaatattatgtgtcgaattttgtcgattaaaatgttgacgcatgcgaaacctcatggtaagctgaataaaaatatgtgtgttctctgcgaaaaattgtgcagagtgcagtgaacgaagcgcacgcaatcgtcaaataccagcttgcgggtcaggaggaaaacgtgaaacgtcttaaaacggcattttcggcggtcttagcgctctcgatggcgctcggcatggtagtcgttcctgcgggagcggccgacggtacttatcagaatgcggtttatccggaacggatatgtagaaaggctcaaccaactacatcaatccgaatcaatcgaaatggtacacctgtagttgaaaagtcgattactgtttcgattccaactggtgatgagccatacaaggatatgtatacggcggatgcacttttccaggatctgacggtcaaccaagaagcaaaatgcaatatttcattgcatgcagaagataaaacaatagtggacgaaaacacggataatggtgtcacatttcgtagagaagaagaactaaataagcagacaaacgaaatagatgtgcactgggacatgattgttacttgtaatgcaaaagcagggcaaacatatcatatgaaagccgagtgtaatggtttatctgacgaactcgagattgttttaatctcggaagaaggttctaaagaagaaacaccgattatagactggattacgtcggctaagggcacatacggccaggcctggaatgaaatggttgatgtttccggttgcagtgcaacgctgaacggcaccgaactttccggcacattcgaggtcgtaaacggtgaaaccgtcccgaatgtcggggacaaatatcggctcaaatttatgtcggaagacagcaagtacactgtggaaagcgaggagttttctgcagaaattcagccgaaaccgctgacaattacggcggaaagtgcagagaaagtgtacgatggcgaacctctggtgaaagatggatacacagcaggcaaactggtgcccggcgacaaaatcatcgaggtgaaggtttccggcacgcagacgaatgcaggaaatgcagaaaatgtaccacataatgcaaaaatatgcggaaacggtacagataagacgaaaaattacgcaatcagctatgccaatggcacgctgaaagttactccgcgggatattgcagacgcgcagattgatatgaagcagaccgagtatgtgtatgacggagtcgagcataatcccaagccaatcatcgcaatagacaataaaacgttgaaaatcaacgtagattacgaactttcttacaccaataacagagactgcggtgcaggaacggtgacaattaccggcaaggaaaattataccggaaaagttgagaaaacattccaaatcacaccgaaaacacccgaaaaggacaccgattacaagattgcattgcctgttgattcgacctacgacggcaagccgtgtgaggcgtcggtgtggacgagaacaggcgttggcgaggtcacagtttggtacaacgacagcacagctttgccggttcgtgccggaacttacaacgtggcggtcgggattgcatcgagtgataacttttctgcggtcgaacgggtgaatgtcggcagttttacaatcaataagcgcacgatttccttggatacaacagcgctgaaagtcgcggacaagacatgcaacggacgcgatgatgatgcacggattagcggtttggcgttcagcaatcttccggaaggcgcggcactgagcgagggcacggattacacgctctcaacacggtacgcatctgccgaagctggcgagtgggacgtgacggttacagttacacttacgaataaaaattacacgttagaggacgaaaactgcactgtaaagggtaaaatcctgccgaaagcggtcgaacttattgtaagcgcgaaggatgcagtctataccggtctgccgtacagcgagagcaatctgacctgctcgggcacgtccgcgccgacatatcgctactacgccgacagcaacggtgcaaagagcaatcagctggatggtgcgccgatcaacgctggaacttactgggtggaagcgtatgcatcggaaacgagcagcacggcttccgcaacctcgcaagcggttcggtttcatattgaaaaagcgccgctgtgtattcgtgctaaggataaaaccataacctatggggaaacgttaagtgataatggtgcggaaatcaatggattcgtgaataatgagaacgaaactgtgctttcgggtctgaactatacgtttggctatgcgcagtttagcgatattggaacttacacgattattccgatgaatgcacaagctgaaaattacaaaatcacatacgaaaacggcgtgttgaccgtacagccgaagcctgttgagataaaatggaacagcgagagtattttctattatgatagtacgccgaaatcggtcacggcagaagcgattggcgcggtgaacggagatgcgcttactgccataatcgaggacggcagccggaccgaaatcggggagtacaccgcacgcgcggtcgctctggcaggcggaaaggcgggcaactatgtgctgcccgaggcacaaaccttctcgtttcagatcaagaaggcgctcgagacggcaactgtcacgccgagtaccgttactgccgtaatcgacggcctgacgattcgactgaccggctttgcgaccgagccgatcacggtttctgcgccggatgccgtggccgcgggcgatacgctgaccatccatggcgtgacgtacacgatcgaccgttccgcagtggatatgcgccgcgcggagatcacgttcgtgtttgcggacagcagtgcgcagaccagcgtttacggcgcgggagatatcggaacggcgtttccgaccgacggcaagcgcggatacacgtttgacgggtgggaaatcggtgataaaacgtacacgacgctgacagaggaagcacttactaaactgaacggcacgcagactgcagcaccggtgttcaccgctcagcagagtggcggaacgagcggcagtggtggcggcggcggtccggtccgcacgccgaccggtgcggtgactgcggctaagagcgagcacggcgaggtctcaatcacgccgaaaaacgcagccaaaggcagcacagtgatgattaaagctgtgccaaaggaaggctatgcgctcaaaacaatcgcggttacagaccagagcggcaagccggtcgcagtgacggagaaggacggtcggtttacattcgtcatgcctgcgtgcaatgtcacgcttacgcctattttcgagagacagcctgctcaaaatgtgaacttcgatgacgtcaagccaaccgagtggtacgccgatgccgtgcgctgtgttgtggaaaagggtctgatgagcggcacaggtacggatgcgttctcgccggatggcacgaccacgcgcggtatgctgatgacaattctcgcacggtacgcgggtgcggatacgactggcggtgcaagctggtacgagaagggcatggcgtgggcgcagtcggcaggtatttcggatggtcgcgcgccggaggctggcattacacgagagcagctcgtcaccatgctgtaccgctatgcggatgtccacgaagccggcggcacactggatgcctttgcagacgcagataccgtcagctcctacgcggtcgatgctatgcgatgggcggcagcgaacggaatcgtcaacggttcgcacggcagactgaatccacaggggaatgccacccgcgcacaggtcgcggcaatgctgatgcggttctgtgaaaagatggaacgataatacattacgccgcgcatgtcggagaacgctgtgcgcggcgtaaattttcgggtctaaaaattttttgaaattttttcagaaaatgtgttgacagattcgtaattctgttatatactaaacaagtcgtcagggatgagacagcgacgacaacgacccgacggaagtttagctcagctgggagagcatctgccttacaagcagagggtcacaggttcgagccctgtaacttccaccaaacgaaaagctcctaaacattgtggtttgggagcttttttctctgtttatttgaactttttacagtgtcgcaagggaagcggcgctttttttgtttttgtgtgaatgtgcttttttggggggggtacgggtgcaggatgtgggactaagtgtgggagtaaaaatcaacggatagagacgacttttttctgcgttttcttcctgctctcggtcgcaaaactgagcacctttaacgaggcgttcgtgaacgcttcatcggagaggtgcgtataaatatgcgacgtcatggcaatcgactggtgacccagaagatcctttgcgacattaagcgggacaccggcggactgcaggtcggtcgcataagtgtgtcgcaggcagtacggcgtgagatcatcagccacaacgacgtttccgggtcgattgcgccgctggccatctgtgcgcccatatcgagatcaagtgcctgcttgaacgagcgccacatctgcttcatggacgtttcggtgtgcggtctgccggtagtcggctgcgtaaaaagatagccgctactcttttcctcgaccttgtgccagagatcgcgcgcggtctttacccggacggagtaccgcttgccattataggtaaacgttttgcggaaacatccgtctgatgtgtttgtttttattgtaaaacatctttggttgtaaaataagagggtagaatgcactcgctaacgctcatcggttgcagccggtgggcgtaatttttatatttagaactcgcgtatcagtacgcgcgggataccgataatacggcatctttccgggtcggtgccctcgatccgtctgggcgggtgagacgggtttcaggggcacaagctctagccaatcctagctctgaacatagttgatgcgtttgatggtcatttcgtcatcgccatagctgatgactccgatctcgccgctgtggttccctggtgttctgcttgagcaccagcacgatatcaccattacggaaatcaggatacatactgccaccgcggacatgcatagcgcagaaatcctccggcttgcggcccttgagataggtgtcgggaacttcgaccattttctcttttgattctttctcctaatgtcagaacaaacacccttactttacatcaaacattcgattggttgtaattagtgtaccacctgcgtgattataaatcacacaaggaggtgtaaaacataaacgcctgaacctatcaggaactccgtcaggggggcaagaacgacctgatgcggatgtattcgaacatggtattgctgacactggagcaagtcgcaaaaatctacggttttactgacaagcacaaagccaagcgcataatcggcgcaccgagagtgtccggcgaacatcgcgtgatgtactatcttggcgacgttgcgaccgacatcgtcaagcggcgtattggcattgtacgataaaatacacaagaaagaagattcaatgtaaaacaacaatttcgcagccaatctggctgcagtcgggaagcacagctgcggcatcaagccgagcaagcgtctttacttctgctggacggaggagtagctcgagcagctgaccgctctgtgggatacgacgtcaaggagctgtggaagggaaaacgtctgcagatacgctatctggttatctgcggcggcgacggcacccgtccgtccggtgagccgttcgtcctgggagtgcaaggggcactgggtcacaagcagaagccgcagtgcgtgcatatttccaacgtccatgccgacctgttgccgaccgatgtttactccggtatgtatgctcgcgtgaccgtcaacttcttcccgtatgacgcttccggcaaccgcggcgtaggcttcggtctgggcgcggtatcagtacggtgaggaccttgtgaagaagcctgccgaggctatgcaggagtaaagcgaaacccctccgagaactggttttatgccggctcctggaggggctgtttttattcagttgccttcggcgtatctccgtcaaagattacatgagcaaagcggaaacgctgcgtaatataggggtacttcttgtgatccacctcggaggcgaacatatcatacggccgcgcgtagattttgaagtcgccgtagagcgcctgatagatcaccagcggttcgccggtttccgtgtgcgtggcgacggcaagcacttgatacagcttgttcttgaaatgcaggtatttttcaccgacaaaaatttttcttgaatccattcatatttcctccaatcctatatttttattataacagagaggagggcaaagaaaaagagcacacccgcaatcaggtgtgctctattctgatggttaatgcgaaaacattccgaactatgaaaaaagtttgtatcttcgcattatggtggacttgaaggggatcgaaccctcgacctctcggatgcgaaccgaacgctctcccaaactgagctacaagcccgaatatatgtgtcaagaaaagcgttttgagcaaactcaactgaacagggaagaacggggactgctttctgtaccgcttccgctcccaactgagcgaatcgccttaatgtcagcttctcgcaagcaatttactgatcaaaccgaattctattcgtttaactcgttaaactactcttgacaattattaattataacggtagaataatttcatgtcaagcactttttccggtgcaaagcaaaaacagcgtgcagcagccagctgtgccaaaaggagaatttaacatgaaaaacagcgaaaaaacaatggaaaagatcgtagcgctctgcaagggccgcggctttgtatactccggctcggagatttacggcggtcttgcaaacacctgggactacggtccgctcggcgttgagttcaagaacaacgtcaaggcagcatggcgcaagaaatttgtgcaggagagccagtacaatgtaggtcttgactccgcgatcctgatgaacccgatgacctgggttgcttccggtcatgttggcggcttctctgacccgctgatggactgcaaggagtgcaaggagcgtttccgtgccgacaaggtaattgaggactggtgtgctgagaacaactacgatctcggcaagagtgttgacgcactcagccaggctgagatgaaggcattcatcgacgaacatgagatcgcatgcccgacctgcggcaagcacaactggaccgacatccgtcagttcaatctgatgttcaagaccttccagggcgttaccgagaacgcgaagaacgagctgtatctgcgtccggagaccgcacagggcatcttcgtaaacttccagaatatccagcgcaccacccgtaagaagattccgttcggcgttggtcaggtaggcaagtccttccgcaacgagattactccgggcaacttcaccttccgtacccgcgagtttgagcagatggaactggagttcttctgcaagccgggcaccgaccttgagtggttcaagtactggaaggattactgccacaacttcctgctgtctctcggcatgaaggacgagaacctgcgtctgcgcgaccacgatccggaggagctgtctcattactccaacgctaccaccgatatcgagtttatgttcccgtttggctggggcgaactgtggggcattgccgaccgcaccaatttcgacctgacccagcatcagaacacctcgggtgtttcgatggaatacttcgatcaggaagcaaatgagaagtatattccgtatgttatcgagccttcgcttggtgctgaccgtgttgcactggctttcctgtgcgacgcttacgacgaggaagtcgtaggtcaggacaagaacggcaaggacgatgttcgtactgttctgcgtctgcatccggctctggcaccgttcaaggctgctgtactgccgctgtccaagaagctgaccgacaaggctatgccgatctggcaggagctggctaagcagttctctgttgattttgacgatgcaggctctatcggtaagcgctaccgccgtgaggacgagatcggtacgccgtactgcgtaaccgtcgatttcgagaccgagcaggatggctgcgtaaccgttcgtgaccgtgacactatggagcaggagcgcatcaagattgaggaagttgctgcttatatcgcaaagaagatcgagttctgatttttcgctgctgaacattgatcatcaaaaccgctgcacaatccctgtgcggcggttttcttttatttggatggcgaacaggaaacaccaccccaaaacctatcgaaaaaatagggattggaccatcggaaattgggcaatctgccggaacgaaaaaagtttgtcggaaagggttgacagaagagggggagtttagtataatcatagcaatcccagcgaaataatatgaatttaggagacgcggttatgcgatactactttgaaaagctgctccgctcgaatttccgatttgggcgaatgtgaaccttctttttagtacacgaaacgaatcaatcacttcaaacatgtatataaaaaggagattattatcatggcaactatcaagaataccgaaaactggtcctttgaaaccaagcagctgcacatcggtcaggagaccgctgatccggttaccgattcccgtgcagttccgatctaccagaccacttcttacgttttccatgacagccagcacgcggctgaccgtttcggtctggctgacgcaggcaatatctacggtcgtctgaccaattccacgcaggatgtgtttgagaagcgcattgcagcactcgagggcggtgttgccgcgctggctaccgcttccggcgccgcagcgattacctacaccattcaggcacttgctcaggccggcgaccacatcgtagcacagaagaccatctacggcggcagctacaacctgctggcacatactctgccgcagttcggcgttgagaccaccttcgttgatgcacacaatctggaagaactggaaggcgctatcaaggacaatactaaggcggtttacatcgagactctcggcaacccgaattccgatattccggatatcgaggctatcgcaaagattgcgcacaagcacggtctgccgctcgtaatcgacaacactttcggtaccccgtacctcatccgtccgattgagtacggcgctgatatcgttgttcactctgctaccaagttcatcggcggtcacggcacgaccctcggcggcatcattgttgattccggcaagttcgactggaaggcatccggcaagtatgcaccgatcgctgagccgaacccgagttatcacggcatctctttcgcagatgcagttggtcctgctgctttcgtaacctacatccgcgctatcctgctgcgtgatactggtgctaccatttctccgttcaacgcatttttgctgctgcagggcactgagactctgtctctgcgtatcgagcgtcacgttgagaacaccaagaaggttgttgagttcctgaccaatcacccgcaggttgagcatgtgaaccatccgtctctgccgaaccacccggatcatgctctgtacgagaagtacttcccgaacggcggcgcatccatcttcaccttcgatatcaagggcggaaaggaagcagcatttaagttcattgacaagctgcagatcttttctctgttggcaaatgttgctgacgttaagagcctggtcatccatccggcaaccaccactcactcgcagctgaccgcagaggagctggaggatcagggtatccatcagggcaccatccgtctgtccatcggcaccgagaatatcaatgatattctggctgacctcgagcaggcattcaactaagctgaatatcacgtattcctattttacctcttacaatttgacgagaaaagacccgctgaaagcgggtcttttcctatctgtacagcagtttcatccctcgatgatggcaaaaataagtgcaattttatcaatcggcataataccccccttttttcggtttgcagtttatataaccggaaaagagagctttatttttacagctgcgagaaaacctcgccgattggcgcgtgaatgaccagatcagcacggcgatccgcaggagtaggggacttattgaccaaaaccagcttattgccgcggtaatagtcgatcagaccagcggccggatacacagccagcgatgtgccgccgataatcagaatatcagccttggagatgtagtctacgctcttgttgatggtgtagctgtcgagtccctcctcatacagcacgacatccggcttgataatgccaccgcaggagcatcgcggaatgccggtgcccttggcgatatcctcaaccggatatggcttgcggcagcgcatgcaatagttgcgtagcaccgaaccgtgcagctcaagcacttccttcgagcctgccttctggtgcagaccgtcgatgttctgcgttacaacggcacggcacttgccttcgcgttcccactcggccagcttgaggtgagccgcattcggctttgcatcaagagccagcattttcgcccgatagaagcgataaaactcctcggtttcgctcaaaaagaacgtgtggctgagaatggtctccggcgggtacttgtactgctggttgtatagaccgtccaccgagcggaaatccggaatgccgctctcggtcgatacgcccgcaccgccgaaaaagacaatgttgtcgctgccgtcgatccactcttttaatttagcaatcttctcatccatgatattagctcctttcgtcgctaatgaattgaaaattaaggtattcggcacagccgaataatttaatgcacgcaagaatagcggcattttccattctcaattttccattatttcgattattcggtaatcgaaactaagccctcatgacgcggctttgccggcgtttccttctcgatgtagccgagctgcggagcagacaacaatgtggtcctccggtacgccgtactcggtcagcagtgcacgaacctcgggtacgtcgcaggtctcgcgcagctggttgatccagcaggagccgaggccaagctcggtagccatcagcagcagattttccattgcagcagcgccgtccaccagagcgtggtgctcatcccgcttgtaggaaatgataatgttgaccggtgcaccgtagaaattgtactgcggaccgcgattgtctgcctcagcgacagcacgagccagcttgagcgacttctctgcattgtaaatcacggtaaagtgccacaggtacttgcccatgccggaaggcgcccattcagcagcttcaacaatctgcatgatctgatccttcggcggcagctcggacttgaacgcgcgcgtagagcggcgagacttgataacttccatcaggttagacatagggaaaaacctcctgaaacaaatagggattgatatttataaatatagtatatagcattcagggtgtcgtttcaagacaacatgaacaaaaatacggctgcatctgtaaattatctgtgaaaacagcggtttgtgtggtatactggttctaattgaaaaataatgcgggaggaatctcttacatgatcactatcagcgatcttagcttaaacttcagcggcgagccgctgttcaaagatgtaaacctgaaatttacccagggcaactgctacggtgttatcggtgcaaacggtgcaggcaagtctacattcctgcgcattctgtctggcgatttggacccgtccaccggcacggtttcgattgcgcccaagacccgtatgagcgtactcaagcaggaccactttgccttcaacgaggagactgttctcaacacggttctcggcggcaacgagcgtctgcttgaggttatgcacgaaaaggatgcgctctacatgaaggatccgttcaccgaggaggacggcaacagggctgctgagctggagtccgagtttgctgaaatgggcggttgggacgccgagaccgaggccagccagctgctgaacggtctgggtctggatgcagatgccatcctgtacaccgagatgaagaacctcggtgacgtcgagaaggtcaaggtgctgctggcgcgtgcactgttcggcaagccggatatcctgctgctggacgagcctaccaaccatctggatattcaggcagtccgctggctggaggacttccttgccgatttcgagggcaccgtcctcgttgtatcgcatgaccgtcacttcctgaacaatgtatgtacccatatcgttgatattgactacggcaagatcaagctgtatgtcggcaactacgagttctggtatgagtcctctcagctggttcagcgcatgatcaaggatcagaaccgcaagaacgaggaaaagatcaaggaactgcagaacttcatccagcgttttgcggcaaacaagtccaagtcccgtcaggcgaccagccgccgcaagctgatcgacaagctgtccgtcgaggaaatgccggcttcgtcccgccgttacccgtgggtagcgtttgacgcggaccgtgaggcaggcaaggacattctcgaggtgcgcggcatctccaagaccatcgacggtgaaaaggtgctcgacaacgtatcctttatcgtgcgccgcggcgacaagatcgcgttcatctcggataacgagctggctatgaccacgctgttccagatcctcatgggcgaaatgaagccggatgagggcagcttcaagtggggtgtcaccacctcgcagagctatttccccaaggataacaacgagttcttcgagggccacgaggagaatatgctcgactggatcgcaccgtattcccgcacggatacactggaatccacgctgcgcggcttcctcggccgtatgctgttctccggcgacgatgtttacaagccggttcgcgtactgtccggcggtgagaaggttcgcctgatgctggcgcgcatgatgctgttcggctcgaacgtgcttgtcatcgaccagccgaccaaccacctcgatctggaatccatcaccgcagtcaacaacggcgttcgtgatttcaagggcaccgtgctgtttgcttcccacgaccacgagttcgtgcagaccatcgcgacccgtattatcgaaattcgtgaaaagggcgttctggacaaggaatgcacctatgacgagttcctcgagttccgcgagacctacaagggctgatgccggagcgctttcggcgcggtctgaacggcctgctcgtgctgctgatactgggtgcgctggcatatgcctcggcgctgctgttcggctggaactgtccgatcaaatacttgaccggcgtgccgtgtcccggctgcggactgagccgcgcacttgccgctctgctccgactggactttcgtacggcactgcggtttcacccgatggttttcgtgctgccgccggtcgttttgtacgcgctgtttggcaaaaagccgcttctcggctccaaaaacctcgagcgcatgctgctgtggagcgttatcgtgctggatatcgcaatttggctgatacgtctcgcgctgcatgacccgctgattttttgaagatttcccgctcgaactgtactgcacggttcgagcggattttgttttattcgacattttgtgcaatatgcaaagattagccggaaatttgatcgggttttgctgtactttttcgtatgcacatgctatactgttgccaaaggaggggatagtttatgatgtttggaattgacagcctgtatatctggctggctgtcattatcatcagtgtagcggtagaggcgttcacactcacattgtgcggcatctggttcgctgccggcggtgtcgcggcactcattgcagccagcctttcggtcggactgatggggcagtggattgtgttcatcgtgttctccgcgctgctgcttgtactggtgcgtccgctctgccgccgttttctcggcagccggcagcaggcgaccaacgcagatcgtatcatcggacagactgccgttgttaccgaaccgattgacaatgttctggagaccggtgcggtaaaaatcaacggaaagatctggacagcccgcagtacgactgacgcgcaaattgcaatcgggacaagagtcacggttgtggagatccgcggcgtcaaggcgattgtaaaaccgaaccaactgtaaaggagcgttatcatggattatattattgtacccatcatctggattgtgctgattgttctgctcatcgcgttcattgcaagcaatatcgtgatcgtgccgcaggcgaaggcgtatgttatcgagcgtctcggtacctaccgcgacacatggagcaccggcctgcatttcaaggtgccgctgttcgaacgcattgcccgcaaggtgaccctcaaggagcaggtagtcgatttcccgccgcagccggttatcaccaaggataacgtaaccatgcagatcgacacggtcgtgtacttccagattaccgacccgaagctgtttgcatacggtatcgaaagcccgatggcggcaatcgaaaatctgactgcaaccacactgcgaaacatcatcggtgatcttgagcttgaccagacgctgaccagccgcgatatcatcaacaccaaaatgcgctccatcctcgatgaagcgaccgatgactggggcattaaggtaaaccgcgtggagctgaagaacatcattccgccggctgccattcaggaatctatggagaagcagatgaaggccgagcgcgaacgccgtgagtccattttggtagcggaaggtaaaaagcagtccgcgattctggtggctgaaggcgaaaaggaagcaactgttcttgctgcagaggcaaatcgccttgccaagatcaaggaggccgaaggtgaagcagaagcgctgcttaccgtgcagaaggcactggcagactccatcaatctgctgaatgaagcggcaccgaccgagcaggttatcaagctgaaatccctcgaggcattcagcagcgccgccgacggcaaggcaaccaagatcatcatcccgagcgagattcagagccttgcgggtctggcaacttcattcaaggaagttatgaccgatccgaagcgcgaacagcccgaaaagtaaaaattgcgttcaagtcctgcagaccgtatccggcctgcaggacttttttgcacgcaaaattgtcatttgtgtccgactcgattcttgacagaagtggactggaatgttatcataagttgaatagatatgcacatattgcgggagggatcaaattgtcggcaaagcatacagacgcagaactggagtgctgcgaggagcatatcgtccatacagatgcagttatggcagcgcgcagcgcaatgccggcagaggagatcactacagccgcatcagattttttcaaagcgttttccgacaagacccgcttgcggatactggcggcgcttgtgtccgcggagctgtgtgtctgtgatattgcgtcgctgctgaacatgagccagtccgcgatatcgcatcagcttcgttttttgaagcaggcgcgactggtcaagagtcgaaaaaacggaaaaacagtatactatgcgctgtgcgatgatcatattcagaccattttggcacagggaatcgcgcacgtgcaggagggataaacggaatgagcgaaaataaccgccctgattcggaacagaagaaggaccagacaacggcggaagatattttagcacaggtcgattcgattttagcggatctggaaaattcggcagtagcgcagctgtttgccgctccggaaaaacctaaacccgaagagaataaaaaaccgcctgaaaaagaagaatcagcgccgcccggcgagcctgagccgccggacaagaatgcggagcagccggaagccgatacatcgcaccaaagtgaaagcgaatctccggaggcggaaacgccgcccgaggaagcggcggcagctgagcctgcaaagccctcggaggaatcaggcgcagctgaggaatcgccggaagatgcggaagacgaatttgacgacgaagaagattcgccggatgagaccgaagacgagggcgactgggacgaaccggaatttgacgacgaaggtatagaggacgagcttcctgaggaagaacaatcagaggaagcggaattcgagcctatcatagaggaaaagccggacaggctgcagaagctaaaagaaaaactgaaaaaccatgaaaaggacaaggcggagaaaaaggaacaggcaaaatccgcacctaaggagaagcctaaaccaaaggatgaaaaaaagccggaggaaaagaagccggaaccgtcagtaatcgaagctccggaggacgcggacgataccaccggtatgaatttcgtgcagaaggcacagtaccgggcgaaaatgcgtcggcgtgagcagacccgtctgcggcgagaaaatgcacgccgtatacaggaaggcgctgaagtgacctatcagccgatgacacggctggatatgcagagtgtaggtgcacggctggctgccgcggcaatcgttcttgtggccggaatcgcaatgggagattcgagcgcggcattgccgctctgcctgctggcgtttttgatcacagcgctgccgattgcagcgcgtgtgctgaccaatctgacacacggctcgtttttcgatgaatatctgctcgtgctaatagcgtctatcggcgcatttgcgctcggcagccgtgcagaagcaacggttgtgctcatcctgttcgagattggcaaaatcgcaggtgatatcgttctggcatccacctatcaggcgttgccgcagcagcacgatttcatgccggaaaaggcaacggtcgtcaacatgaagggcgaacagcgtcaggttccgctggcagatatccgtctgggtgagctggttctggtgcactcgggtgagcgcgtaccgattgacggtgttgtgcttcgcggagacggcacggtggatgacagcgtgcttaccggtgaaaacgtgccgatggcagttgataagaatacgcgtgtgctggcaggcagccagtataacggctctctgatgctgattcgtgtgatctcgcgctacgaggactgcgcggttcgtcagattcgccgagtacagaatgcagctgccgaacacaaggcagcgttggaaaacagtgcgcagcgtaatgccaagcgcctggttccggttgtgatcgtcattgccgtactggcagccgcacttccgccgctgttcatgcccggttcggatataaccggctgggtatatcgcggactgacgcttctcatcgcctgctgtccgaccgcactggcgttggctgtaccgcttgcttttgtatgcggcggcggccgacttgagagcgaaggcgttcacatgaagggcagcgaagcgatggaacggactgcagacttgcgtctggtcgtattcaacaagaccggcacagtgaccaccggcaatctgcaggttaaaaagatttatcccacgcaggagttctccgaaaagaactgtttggcacttgccgcagcagccgagcagctttcgcagcatccggttgcacgcgcaatcgtaagtgcatgccgggaaaagctgccgaagatcgaggaattcgaggaattccagggccgcggcgtgcgcgctcgtatcggtgatcatgttctgttggtaggcaaccgcaagctgatggtctcccgcggtgtcaagggtttgccggatatcgacggcacggttgtttacatcgcctgtgaaggagagcacatcggcgtgattgaattggaggatacggttcgtccgtctgctgctgacgcgatcaagaagatcaaggatcagggcgttgagcgtactgtacttatcaccggtgacgctgagacaccaacccggcgaattgcaaatgccgccggtatcgataccgttcactgcagcttgatgcccgaggaaaagcaagcgaagctggactttatgatgcgcacgattccgacagacggtacgaccgcctatgtcggcgacggcgtaagcgatatcgagcagctcaagatggctgatgtcggtgtggtaatgggcacgcgcggctcccgctattcagcggatgcggcgaatgtactgattaccgcaaatgatctgagcggtctcggcgaagctgttcaggtctgcaagagtacacacggagtggcaatgcagaatctgacactgctggctgccatcaagctggtgcttgctgtactggcgctgatcggtctggcgcagatgtggatggcagttgtcgttgatgccgtactcacggtgctgactgtgttcaatacgtcccgactgctcggcagtaagccggaaatttcagaggaataagcaaaacgcgaagaaagtgtaaagactttcttcgcgtttcttttttgttttgtgtactttctgcgcgaaaacagtcaaaaacagtatggtttttttcggaaggatatgatacaataatctgtatgaatgaaaatggaggaatacgtcttgcataaaaagatggaagccattttgtcccgtgtacagaagccggcacgctacgtcggcggtgaatggggctcggtgatgaaagataaaaagaacgtcgatctgcgatttgcgttctgttttccggatacctatgaggttgccatgtctcacctcggttcgcgtatcctttacggcctgctcaatgatcagaagggcatctggtgcgaacgcgtctgcgcgccatggatcgacatggaggctgaaatgcgcgaggccggtctgccgctgtacggtctggagagcggtgacccattgtcggactttgatattatcgcgtttacgctgcagtacgagctgtcgttttccaacattctgaatatgctggatctcggcggtattccggtgctggcaaaggaccgtaccgaactcaagcatattgtagcctgcggcggtccgtgtgcctacaatccggagccgctggctgacttcgttgacctgttcatgatcggcgacggcgaggagatcatgctggaatttaccgatctataccgcaaggccaagcgcgaaggttggtctaagcaggaattcctgattgcggcagcacagatcgagggcatgtatgtaccttcgctgtacgaggtcaagtaccacgaggacggcacaattgagagcgttacgccgacacacggcgcacccgcactcgtgcagaagcgcatcgtcaaggatctggataccatgtactatccggagtccttcgtcgtgccctcgacggatattgtgttcgaccgtgcgatgatcgagctattccgcggctgtccgcgcggctgccgattctgtcaggccggccacacgtatcgtccgctgcgcaccaagtccaaggaagtgctgctcaagcaggcgcaggcggtgctcaagcactctggttacgaggaaatctctctgtcctcgctgtccaccagtgactacggcgaactgtccggactgaccgagtgtatgctggattactgcgagccgcgccacatcagcctgtcgctgccatcgctccgtgcggacagtttttccgccgagctgatggagcgtgtgcagaaaacccgtaaaagcggtctgacgttcgcgtgtgaggcaggcacacagcgcctgcgcgacgtgatcaacaagaatatccgcgaggaagatgtactccacgcctgcgagatcgcctttcagggcggctggaataacgtcaagctttatttcatgatgggtctgccgaccgagacctacgaggatctggacggcatttccgacatttgcaaaaaggtcgcctattgctggcgtgagaacacgcccaaccgtgcgcgcggcgtgcgtatcacagcgtcggcttcgtgctttgtgcccaagccgcagaccccgttccagtgggacgcacaggacacgctcgagcagttccgcgagaagcaggcgcacctcaaggtggtcatgaaaaccaagaatgtcacctacaactggcatgatgcggagacctcggtgctcgagggcgttattgcacgcggcgaccgccgtcagggcaaggcgattctgctggcgtggcagcgcggctgcaagatggacggctgggatcagtgcttcgactttgacaagtggatgcaggcgttccgcgactgcggactcgatcccgcgttctacgcatcccgtcagcgtccgatggacgaggtgttcccgtgggatcacatcggctgcggcacgcgcaaggagcatctcaagcgtgagtgggagcgttcccgcgaagcggctatcacgccggactgtatgcaccagtgtgccggctgcggcgcaagcgctctgctgaagggaggcaagtgccatgtttaaggctcgaatgaagtttgccaaagagggaagagccaagtacatctctcacctcgacctgatgcacgccatgcagcgctcgatggcacgctgccagatgccgctgtggttcaccgagggtttcaatcagcacgcctacgtttcggtggcgctgccgctctcgaccggctactccggcgagtgcgaatttctggatttcaatatcacggcagaagccgtgccggaaaatgcggtggaagcgctcaatgatgtatttcccgagggcctgcgtgcaatcgagatttacccgcttgccgacggcggcatgaaggtcggttcgattgaatggtcgcagtaccgcatcacatggggttttgaggatggtacgcccaagggctttgccgacgatgtgcgcaatctgttccgccgcccggtggtcgagatcgtcaagcgctccaagcgcggcgaaaagacggtcaatatgcgtgagctgatgcgcgatctgaccgttaccgacggccctgatgaggtgaccgctgttgtcaccaccgctgccggcaataacaacatgagtccggaatatctgacccgtgctatccggcagtatctgccgcagtacgagattccgttcagcgcgtaccaccgcatgaacgtgtttacttctgacggcactccatttcgataaaaggagagtttcatggcaacccagaatgtttccgaagaacagctgcaatcgcagtttacctatattgacgcagtagcccgcctattgggggacaagcgccccaaagcctatacgcatacgttcggctgccagcagaacgaggcggataccgagcgtatccgcggcatgctgtccgaaatgggctacgaaatgaccgatacgcccgacgaggcagattttatcctgttcaacacctgtgctgtgcgtgagcatgccgaggatcgtgcgttcggcaatgtcggcgcactccgccatctgaaaaaggagcggccgggcattgttattgcaatgtgcggctgcatggcccagcaggagaaaaacgtcgagaagattaagaaaagctatccgcaggtaaatctcctgttcggcacgcatgcgctctggcgatttccgtcgctgctgtaccgcgtgctgaccgagaaaaagcgcgtgttcgacatcggcggcgaggacgatatcgccgaaggtctgccggtgctgcgtgccaagggcgcaaaggcgtggctgtccatcatgtacggctgcaacaatttctgcacctactgcatcgtgccgtatgtgcgcggcagagagcgcagccgccgaccggaggagatcgagaaagaactgcgtgagctggtcgcggcgggttacaaggagattacgctgctcggccagaacgtcaactcctatggtaaggatctcggcattgacgtggattttgccgatcttctgcgccgtcttaacgccgtgcccggcgatttctggctgcggtttatgacaagccacccgaaggacgcgtctcccaagctgttctctgctatggcagagtgcgataaggtcgcaaagcagctgcatctgccgttccagtcgggcagcgacgaaatcctgcggcgcatgaaccgccgctacacggcagagcattacaaatcgctgattacggatgcacggtcgaaaatgccggatattacgctgtcaagcgatattatcgtcggtttcccgggcgaaacggacgaggatttcgagcagaccctgaagctggtgcaggatacccggtttgatctgctgtttaccttcctgtattcgcctcgcacgggcacgcccgcagcttcctatgaggataacgctacgccgcaggataagcagcgccgattcgagcgtctgcttaaagcgcaggatgaaattgttgctgaaaagcaggcagcttatcagggcaggaagttgcggctgctcgtggacggcaatgccaagggatcggagtatccgttcactgcgcgtaccgagggcaacctgcttgtctgcgtgcgcggtgacgatatcaagatcggtgaatttatcgaggcagagatcgagaaaacctcgcttcgctgtctgtttgcacacaaattataagaaagaggtaagaacatggctgaactgacgcccatgatgcagcagtattttgagatcaaaaacaaaaataaagattacattctgttttaccgtctgggcgatttttacgaaatgttctttgacgatgccaagctggtctcccgcgagctggagctgacgctgaccggccgcgactgtggtcagggagaacgtgcaccgatgtgcggcgtgccgtatcacagcgcggaaggctatattgccaagctggtgcagaagggttacaaaattgcgatctgtgagcagatggaggacccgaaaaaggcaaaaggcctggttaagcgcgagatcatccgacgcgtgacaccgggtacggtcgtggaggcctccatgctggatgaaaaccggaacaactttctcggctgtgtatatgcagccggtggttccgtcggcgtatgctttgctgatattacgacgggttcggtgtacgcgaccggctcggataactggaatgatatcaccagcgagttcggacgctttgcgccgcgtgaggtgctggtcggcggcggagccattgcggcagacggccttcagtcctttctgaaggaacgtctggaggcgctcatagagccgatgccggaggagtgctttgaggcacagcgcagtgcggaacgcattcaggagcacttcaaggtgcaggactttgacgctgcaggtctgaccgacctgccgtgcactgtgcagtgcctcggcggtctgctggattacctcgagcagacgcagaaggccagcctttccagtctgaatcagctgcaggtgtaccatcaaggccagtatatggagcttgacctgatcgcacgccgcaatctcgagctttgcgagaccatgcgtaccaaggagaagaagggcacgctgctgtgggtgcttgaccacacgcgcacggcaatgggttcgcgcctgattcgtcagtggattgaaaaaccgctgtataatccgctgcatattgcacgccgtcagcaggcggtaggtgcattgtgtgacgatgtaattgcccgtacggcattgacggacgcactcaagcgggtgttcgatatggagcgcctgattgggcgcgtagcctacggcactgcaaactgccgtgatctgcgtgcgctgtcggcggcaatttcttgcctgccggagatcaaaacgcaggctgctctgttcggacaggctatgctgcgtgagctgaccggcaagattgatctgcttgaagacattcgcgcgctggtcgagcaggccattgtggatgagccgccgattcttcttcgggaaggcggcatgatccgcaagggcttcaacgaggagattgaccgtctgcgcgaccttgcgtccggcggtaagggcaaaattgccgaaatcgagcaggcggaacgcgagcgtaccggtatcagcaagctgaaaatcggctacaaccgtgtgttcggctattatattgaggtcagccgctccaatgcggaggcggttccggagaactatattcgtaagcagacgcttgcgaacagcgagcgctatatcaccgaggagctgaaacagctcgagagcacagtgctcggtgcgcaggaacgcctgaccgctctcgagtacgaggtattcgtttccgtacgcgaccagattgccgctgaggtccaccgtgtgcagaaaaccgcgcaggccatcgcagcgcttgacgttctgtgcgctctggctgatgtggcatgtgataacaactatgtttgtccggtggtggatttttccgaccgcattgccatcaaggacggccgtcacccggttgttgagaagatgctgtcagacagcctgttcatcccgaacgacaccctgctcgacagcaaggaaaaccgcgttgctatcatcaccggcccgaatatggcaggcaaatccacctatatgcggcaggtggcactgattaccatcatggcgcagattggctcgtatgtaccggcctcgtccgcgcatatcggcgtggcagaccgcgtgtttacccgtgtcggcgcgtcggatgatctggcgagcggtcaatccaccttcatggtggagatgagcgaggtcgcggatattctgcggcacgctaccaagtccagcctaattattctggatgagattggccgcggcacctctacctatgacggcatgagtattgcccgcgcagttgtagagtatgtagcggacaaaaagcgcatcggcgcacgcgcgctgtttgcaacgcattatcacgagttgactgtgcttgaagatttggttaagggcgtcaagaattacaatatcgcggtcaaaaagcgcggtgatgacattacgttcctgcgcaaaatcgtgcgcggcggcgcggatgacagctatggcattgaggttgcaaagctggccggtgtgccgaatccggtcatcaagcgagcaaaggctgtgctggctgatctggaatccaccatgccgaaaatcgagctgcacgccgtagccgaggaaccggaagacgttccgcagattacgatagattcgctctccggcgatgcagtcgcagagcggctgcgtgcactgcaggtggataccatgacgccgatcgaggcgctcaacgcactgtatgagctgaaaaagctggtttaatcatttatcaaggcaggaaagaccaaccatgatttgttccggaaaggaaaacaaagaaaaatggcagtgattcatgaattatctccgcatcttgcggatctgatcgcggcaggagaggttgttgaacggccgtcctctgtggcgaaggagctggtcgagaatgcgattgacgcaggttctacccgcattacggtggagatcgaaaacggcggcattacctatctgcgtattgcggataacggctgcggcatgtcggcagaggatgcacctgtggccttccgccgccacgcgaccagcaagctgcgtaccgaggaagatttgaatgctatcggcacattgggcttccgcggtgaagcactggctgcgatttcgtcggttacgcgcattgatctgttcacgcgtcaggcaggttcgattgcgggtctgcacctgcatctggaagccggtgagattcagacacaggaggaagccggctgtccggaaggcacaacaatcgttgtgcgcgacctgttcttcaacacaccggctcgcatgaagtttcttaaaaaggacttcaccgaggcgggttacattctcggcgtagtacagcacgcggcgctctcccatccggagattgcgttcacgctcattcgcgacggcaagcaggtattctcgtcggacggcaagggcaagctgattgcaccggtgttcggcgtattcggcaaggaaatgactgccaatatgattgaagtgccgatgaccgagcgcaacggtatgaccgtgcacggctacattgtcaagccgcatgccggacgtgccaaccgttccatgcagcatttttttgtcaatggccgctatgtcaagagccgtcttatgcaggctgcaatggaagaggcctatcgcaatgcgatcatcaccggcaaatatccgtctggtgcgcttttcctggatttgccgctgtcggcggttgacgtcaacgtgcatccggcaaaaaccgaggtcaaattttcgcaggaaaagccgattttcgaggtcgtgtatattgcctgcaagaatgcacttgccgcaaacgacaatatgccgcatctggagcacaaggagaaggaagcgcctgccaagccgcgtgaagataatctgacgcatgagcagcagcggtttgcgattccaaagccggtagaccctaagccgtttgtcataccgagtgtcaagccaacaccgattgcaccggtaaagaacgaagaggaagcaccggatttagaggatttcctcgtgtccatcccgccaaaggtagagcgtccgcgcagtgcatcgagttatctgtccgcgccgcgcatactgcaggaggaaccgcagaaaccagttcgtactcgaatggcacagccggtcgagccggtcacagaaccgacacctgccgtgcatacgccggcaccggagccggaagatgaaccgatggtcgttgtgccgtctgtcagcgcaccggaggttaagggtaagccgcagatcttgcagccgctggataccggtgtgcgtgtgatcggcgaatgctttcagacgtacatcattgctgaggacaaggacggcttgattctcatcgacaagcatgccgcgcatgaacgcattctgttcaacaagctgcgtgcggagaccgatatgccacagcagcagcttctcacgcctgtaattgtagagctgactggcgaggaagccgccgctgtgcagtcgcagatcgaggacatccgtcaggcaggcttcgccatcgacagctttggcgagaacagctttgccgtacgcagcgtgcccgcttatctggatagcggcgatgtgcagagcgtcatcagtgaattggccgaaaaggcgatgaacagccgtaccaccgtgccggatcgtctggacgatttaattcatacggtagcatgcaaggcagctatcaaggcaggcaaaccgaccacaatgaccgaactgcaggacctgtgcgagcgggtgctgagcgatgacaacgtgcgttcctgcccgcatggcagaccgacgaccgttcgtctgaccaaatatgagcttgacaagatgttcaagcgtgtaaatcaataaaaagcgaggaaacagcatggaaaaccgtttgatctgtatctgcggaccgactgccagcggcaaaaccgccttatcggtcgcgctggcgcaacaactgcatactgagatcatttctgcggattccatgcagctttaccgtgagatggatatcggcaccgccaagcctgatatgaaggaacggcagggcgtaccgcatcatctgttcgatgtgtgcgagcccggcgaagcgttctcggtggcacggtatgtcgaactggcagacgctgctgcgcaggatattctgtcgcgcggcatgatgccgatcgttgtcggcggtacaggattgtacatggacgcgctcatcgagtgcagcgtattctccggcgatgagaccgacctgaccgtgcgtgagaaatatcaacggatggcggctgagcagggcaatcaggcggtacatgactgtctggctaaggtagatccggccggagcagaacgtctgcacccgaataatctcaagcgcgtcattcgtgctcttgaggtgtatgagcagaccggtatgacgatcgacgaatttaaccgcaggaacaagcgcccggagccaaagtatgatgcgctcaagatcggtgtttgcccgtctgaccgtgaaattctgtatgaccgcatcaaccgcagagtggatcttatgatggaaaacggtctgctggaggagacgaaacggctggtggagcgcggtctgctgaccggcactgccgcgcaggccatcggctacaaagagctgctcggctatctgagcggcgagcaaacattggaagaatgtaccgaattgctcaagcgccgcagcagaaattatgcaaaacgtcagcttacctggctgaaaagggatgacagcatccactggatatattataatagtggagaagaacttcctttcgtcttacaggaaacgacaaaatatcttcaaaaccacggtgtacaatgataccataaattgtaatttcaactggaggaatcattgtgcgaaacgaaatcaacttacaggacagaatgctcagtgcactgcgtcagcaggcgcagaacatcaccgtatttttaacgaacggctttcagatgcgcggtatcgtccgcggattcgacagcttcgttgtgattttggagagcgacggaaaacagcaaatgatctataagcacgcaatctctactctgatcccgcagcatagagtcgatctccatgcaccgagaggggagcgtgcggaacagtgaacatatacgaggtctttacatgggacaacagacaaaaagcacaaaatccaagccgcgaaaacggcggaatgacggcggaaaccgcgttgtatttatcattgcggcggtactgatggtgatttatctgggcggccgtctttctaacgcgttttcggctgcaccggagaccacaccggctctgcatgtcacagttaatgacagctttacgagcgatggctggttcttccgcgatgaagaaccgatcgacaatgccacgggcagctcggtcaagcacatcgtgtacagcggtgaacgcgtacagcaggacgcaccgctggcgatcatctattctgatcaggaatctatggacctgagccgacagcttgatccgctggaggaacgtatttctcttctggatacagcgctgcagtccacatcggacagctcaaatatcgcaaagctggatcaggtcatcacgctgacgatcgagcagctggccgagcaggtgaaggaaggcagcggctcttcggtcgcgtctgccgcaagttcgctgcgcacgctgtcgctgcgccgcgaggccggcaatgtggataccaacgaggtatctgccgaacgtgacgctttggtttctgagcagtcctcgctcgagcatcagcttaccggccgaaccacggaactcactgcatcctcgtccggatatttctccgaggtggtggatggatacgagagcattctcacaccatcctcactggatgagatgaccgtggagcagtttgacaagaccgttgcgcagcagccgtctgctgagaacagcaattcgctcggcaagatcgttaagggattcaactggtatctggcagctaagattccggccgagcaggccgagcgtctgcaggtcggtcaggagctgacagtaaactttacgcaggcttcgatggaatccaaagtaaccgtgcattccatcaaccatcaaggtgacagcgatacggctctgctggtgatggaaggcacagaattcagcagtgaaatggtttccatgcgcgaacagccgatcgaaattatcattgcgacctacaccggactcaaggtgccgaagagtgccgtccgtgtgcaggaacaaacagacagcgacggaaagaccacgcagatccccggcgtgttcatcctgagcggctcgatacagaaattcaaaatgatcaacgagctgtttgaggcggacgattattatgtcgtcgaacaaagtgcgaccaactccgatatgctggtcgagcgagaccaggttatcgttcaaggtaaaaatctgcaaaacaatatggtggtgaagacatgacggagcaagaaaagaaagaactgcaggaacgcgtaaaatctgtgatcgagcgcgtaaacaatgccgccgtgcaggcagggcgcgatcccagtgaaattacactggtggctgcgaccaaaatgaatgacgccgagcgcgtgcaggcggctatcgaagcgggaatccgtgtgtgcggcgaaaaccgcgtacaggaactgcaggagaagtatgaacagaacgcctacgatggtgcagaccttcagtttatcggcacactgcagaccaacaaggtcaagtacctgatcggcaaggtttcgctgattcagtcggtcggctcggttcatctcggcgaggctatcgccaaggaagccgagaagcgcggtgtttgtcaggatattcttctggaggtaaatatcggcagagaaactgccaaaagcggtcttccgcccgaagaactgcacgatgcaattgtaaaattgagcgcaaaaaagtcgcttcatatccgcggattgatggcaattcctcccgttgcggatgaaaaaacaaaaaattcaaactactttaccgaaatgcgtcaagtatttattgacattttgacgaaaaaatacgataatgtagatatggattatttgtctatgggaatgacgaatgattttgaaacggcgattgcgtgcggagcgaacatggttcgcgtaggcacggcgatctttggcaaacggccgtatcagatcgtttcgccttaaaacataaggaggaacttggcatgggttcaatcaaaggctttattgattgggtaaagggcagcgagttggaggacgactacgaagacgagatgccccgtcagagaaacgaagaacctgcgatggatagcgagccatcatcttacaatagaagatcctatgaccgttcgtacgacagtgatgcacaggacgcgcctcaggtgcgccgtcacgatcgcagcgataaggttgtaaacatcaatactactacacagttggctgtggttctggtcaagccggatcgctttgaggcggctgcggaaattgcagatcatctcaaggacaagcgtacggttgtcctgaatctggagcagaccaacaaggatattgcccgccgtctggtggatttcctcagcggtgttgcgtatgcaaacgaaggcaagatcaagaaggttgcaaacagcacctatattatcacaccctacaatgttgatattatgggcgatctgatcgacgaactggaaaacagcggtatgtatttctaagcgcagatcgtgagtactatcgtgaacagcttggtaatatatttcgtaggcagcttattgcgcattctgcagtttatgttttttgcacgggcaatcatgagctggttcgtacagggcagcgactcaaaaatctacgagtttctgtgccttgttaccgagccggtcattcaaccttttcgcagtctgctgagccgcgtgagtgcgctgcggaattgtccgtttgattttgcgtttatgctggctttttttgttctgattgttttagaacaaatggtatatatgctttaagcctgccggacaaacggcgctgattttggtcgggcgcagcccgaccatttttccgtgtcagtacggcaaatgatataaaaacggaggaaaaacatatgacggtgcaggaaatacaagaaatcggctttgaaaaagcggttttcggcggatatgacatgaagtctgtcgatacttttctcgagcgtgttgcagaggaatttgcagcgatgcagaaggaaaatgctgctatgaaggcaaaaatgaaggtgctggtcgataaaattgaagaataccgcggtgttgaagaaggaatgcaccgtaccttgctgaccgctcagtcgattgcacaggagacaatcgacaaggcgaagaaggaagcagaggagatcattgcttctgcgaaggatgaaaccgcaaacaaggtgaaagacacccaggcggaaatcaacaccgaggaacagaaactggagactgcccgcaagaacactgctgagttcatcgctcatgtagcaaagctgtatcagtcgcaggcaagagcactggcagagttggcgaagggcgaaaacctcgctccggtacagcagactgaagatgcaaagaacacaaatgcgactgggaagggcgatgcaccagtggaagatgcaacgcgtaaattcgacttcggcgaactgcagttcggcactgaatacgacccgaaggacgttaagtaaataagcgaaaggactgaatactgcacaatgcagcaggattacaacaatacgatcaatttgcccaaaaccgaattcccgatgcgtgccggtctgccgaagcgcgagccgggttttctggaaaactgggagaagaacgacctctaccatgaactgatgaagaagaacgagggcaagccgcttttcgttctgcatgacggccctccgtatgcaaacggcaatctgcatatgggtcatgcactgaataagatcctcaaggattttattctgcgttcgcgcaatatgatgggttatcaggctccgtacattccgggttgggatacccatggtcttccgattgagcgtcaggcaatcaaggcttacggcatggatcgcagcaaggtttccactgcggagttccgctccaagtgtgaagagttcgcacacgatcatgtcaatacccagcgtacccagtttaagcgtctgggcgttatcggcgactgggatcgcccgtacctgaccctgacccacgattacgaggctgctcagattgagattttcggcgagatggctaagaagggttacatctacaagggtcagaagccggtttactggtgcccgcacgacgagaccgcactggctgaggcagagattgagtacaaggatgttccgtgtaagtctatctttgtaaagttcgctgtaaccgatgacaagggtgttatcaccaagctgcttggtaccaaggagaatgtatatttcgtaatttggaccaccactacctggaccattccgggcaaccttgcaatttctctgaacccgaacttcgagtacgatttcgttaaggttccgaatggcgagatttatgttctggctaaggaactggttgcttctgttatgaagaccgcccgcattgacagctgggaagttctcgcaaccgttctcggctctgatctggagctgatcaagaccaagcacccgctgttcgaccgtgattctctggttatcaccggtgaccatgtaacgctcgatgccggtaccggctgtgttcataccgctccgggctttggtgctgatgactttatcgtttgccagaggtacaacattccgattatcgttccggttgacggcaagggccgtcacaccgccgaatccggcaagtacgagggtatgttcgttgacgattccaacgaggttattctcaaggatctggatgactgcggcgcacttctcgcaaccgaggacatcgtgcacagctatccgcattgctggcgctgcaaaaatccgatcatcttccgtaccaccgagcagtggttctgctctgttgatgcgctcaaggatgacgcagtcaaggcttgtgaggacatcaagtggattcccggctggggtcaggagcgcatgacctccatgatccgtgagcgttccgactggtgtatttcccgtcagcgtgtctggggtgttccgattccgattttcacctgcaagaagtgcggcaagccgctggtaaatgagcagacgattaagaccgttgctgatctgttccgtgaaaagggctccaacgcatggttcgacatgacggctgctgagattctgccggcaggcaccaagtgtgagtgcggctgcagtgagttcgacaaggaaaccgacaccatggatgtatggtttgattccggttcctcctggcgtgctgttatcgagaaccgcgaaggtcagaagaccccggttgacgtatatctggaaggcaatgaccagtatcgcggctggttccagtcctcgatgctgacttctattgctacgcagggcaaggctccgtacaagacggttatcacccacggtatgattgttgatgaggagcgccagaagatgtccaaatctctgggcaatggtattgctccggaggatatcctcaagcagtatggcgcagacgtaatgcgtctgtgggttgcttcttctgactaccgtcaggatatgcgtatttccaaggacatgctcaagcatctgtcgcagaactacctcaagatccgtaacacggctcgctacattctgggcaacctgtttgactttgatcctaagaccaacgctgttgcatacgcagatatgccggagctggataagtgggcactgatgaagctgaacgaccttgctgcaaaggttcgtgagggatatgatagctacgaattccacaccgtattccatgcaattcataatttctgtgttgttgatatgtccaacttctacctcgatgtgatcaaggatcgtctgtactgcgatgagactgatggtctgagccgccgctctgcacagactacgatctatcgtatcctgagtgcgctggttcgcatgctgtctccgatcctgtgctttaccgcagacgaaatctggcaggctatgccgcacgctgctgaggatgatgttcgcaacgtagcatataacgagatgccgcaggctgacgaggctctgtccttcagcgatgaggatcgtgctaagtgggacaagctgacagcattccgcgatgatgtaaacaaggcgctcgagggtgcgcgtactgctaagaccatcggcaagccgctggaagcatgcgttactgtttacgctgacgctgaacaggctgcattcctgaacggctgtggtcaggatctggctgatctgtgcattgtttccgaacttgatgtcgttgccggtgacggtgagggcgctgcaagcgagaatctgccgggtctgaagattgctgttgcccgcgcagcaggtgagaagtgcctgcgttgctggaagcaggctaagaccgttggttctgatgcaaagcatccgggtctgtgtgctcgctgtgccaaggttgtaggctaaaagaagaatccaagggggagcagagcaattctgttcctcctttttgttttggaggtagaagatgccgatttatatttgtgcaatcttgctgatgatcgcagcagatcaggcagtgaaatactgggcgtttacgtccctgcaggcacagcagaccattccgttgatcaatggtgtgtttcacttgacttatatcgagaatcgcggtgcagcattcagcctgttcgcgcaatttgattcacgctggatttttgttgtattggccattgtgattacagttgccattttcacagcgatttacaagaatatgctgcagactcagttgggctgctggtctctgattctggtggcggcaggcgcactcggcaacgccattgatcgtgtagcacacggttttgttgtcgatatgtttgacttccgtctgattcattttccggtatttaatgtggcagatatcttcatttgtgcaggtggtgtactgtttgtgctatattttatgtttcagcacaaggaaacaagcggagcggagaagtaaccatgagtgaattacaatttacagttccggcagagcaatccggcaagcgtatcgacagctggctggcagagcagattgaaggactgacccgctctgcggcgcagaatctgctgtcagagcaggcagtaagctgtaacggtcagccacttaagaaaaattataagctggtcggcagcgaggcgattacggttcagcttccggagttaaaggaagtagatctcaagccggagaatattccgctggatattgtttatgaagatgcggatattgtggtggtcaacaagccacgcggcatggttgtgcatccggcggccggcaactgggacggcacgttggtaaatgcattgatgtaccactgtggtgacagtctgtctggcattaacggtgaacatcgaccgggcattgtgcatcgtattgataaggataccagcggtctgctcgttgtggcgaaaaatgacgccgcacatcagagcctggcagctcagattgcggcgcatacggcgtatcgcggctatgaagcgattgtggttggttctgtcaaggatgataccggaacggtggataagccgattgcccgtcacaagacagatcgaaaaaaaatggcaatcgtggagggcggacgtgaagcaatcacgcattatactgtcatcaaacgatataacggctacacatatatggcatttcagctcgagaccggacgtacacaccagattcgtgtacatatggcatctattggtcatccgattatcggtgatccggtgtacggactgaaaaaagaccggttttccaatatcggcggtcaatgtctgcatgcagcgaagctgacgctcacgcacccgaaaacaggggagcggatggagttttcggcatcgctgccacaatattttactgaagttcttgataaattggagcgtatgcaatgaaaaagtttaagggtatgctgctggcctgcgatatggatggtacgctgctcgatgattcaaagcaaattccggcagaaaatttgcgcgcattacaatattttacgaaacagggaggacggctgtcgcttgcgaccggccgttctcctcatgctattggcacatatatagaccagttgccggtcaatgcgccatacagtgtgatgaatggttcgttgatttacgatgaaaatcgcaagattttgtattgctccggcatgccgtacgagacgaaagaaatgatcgagcatgtattgttaaataattcacaattcggttgcgaggtttttactgcagaaacggcgctgattcgtcaaatgagcgatcacacgctgcagcacatgcacaagctgcatttggattatcagatgctttctaatgagcagtttgcaaaaagcgcaactgcggactggtgtacggtcaattttaccggtgaaccggcacaaatcaccgcacttacacaggatttactgattcgatatccgcatgtatttgatgtgacatccagcatgccgacattctgtgaaatcacagccgctggtgtgaataagggttcggctctacgaaatattgttgaatacttaccagacgttgaacgtgtgtttgctattggcgacagctacaatgatgaatccatgctgcaagaagctcagatttcgtttgcaccggccaatgcagagccggaagtgctgcaaaatgtcaatatgacggtaagttctaataatgatcgtgctgtggctgatataatagagtatctggagaaaataggatgaaagactgttaattatcaattgtctataaaataatggtttgctaattatacaaaatctttattttgtataattgaaggtgttggcaattacgcagcacctctgctgcgctgaccgtcctaatttttctcattcagcttcttctatcctcgtaagacgttctataatttgttgcaattggttatgtatcggcacacaattgtttttctgtgatgcatctttcgtgcagtgacagcaaacacaattgtcacatttagtcatagcatgctcatatctttctgttgtttttttatgtgcaatagattttctatacagacgaaagcggctcttacagagccgcttattttagttatcccacattcttcaaccaaaactgctcaaccatccgaatgaaatgctgatgcaccgtcaaatcctcatctaattccggatgaaatgcggtcacgagcatattatcctgctgtgcagcaacaatattactgtcaacaacggatagcacctcgacattatttcctacgctctcaatatatggtgcgcgaatgaatgtcatcggtattctctcgctaccgccaaaccaatcatccgtgaaaaaactgccaagctgtctgccataggcattacgctttacgcggatatccatcacactgaagcatggtatgccaccatcaatctgcttagccagcagaatcagaccggcacaggttccgaatacaggaagtccgctttgaatccgctcacgcagcgtatcatacaaatccagctcgcgcaagagtttattcattactgtgctttcgccacccggaataatcaaaccattcatcggctgatccagatcgcgcttctggcgaatttcgaagtgcggtacgccgagtttatccagcactgcggcatgctctgcgaaggcgccctgcagcgccagaattccaactgccattttacttgcctcgctctgccatcagcaatgcgatttcgttctcgttaatgccaaccattgcttcacccagatcggtagacagttctgcaatcagctttgcatcggtgtagttagtaaccgcctttacgattgctgcagcacgctttgccggatcgccagacttgaagatgcccgaaccaacgaatacgccttctgcgccaagctgcatcatcagtgctgcgtcagccggagttgcaacgccgcctgctgcaaagtttacgaccggcagtcggccattttcatgcacacttcggagcagttcaaccggaacctgcagttgctttgcggcctcaaacagctcatcctcacgcagattctgcacacggcgaatttctgcgttcatagcacgcatgtgacgaactgcctgcacaacatcacctgtgcccggctcacccttggtacggatcattgctgcgccttcagcgatgcggcgcagagcttcacccagatcacgcgcaccgcatacaaacggaaccttgaactgtgtcttatcaatgtggtatacatcgtccgccggagacagcacttcactctcgtcaatatagtcgatctcgattgcttccaaaacctgtgcctcaacaaagtggccgatacggcacttcgccataaccggaatggaaactgcttcctgaataccgcgaatcatctttgggtcgctcatgcgggaaacgccgcctgctgcacggatgtcagccggaatgcgctccagcgccataactgcacatgcgcctgctgcttcggcaattttcgcctgctccggtgtggttacgtccataatgacgccgcccttcagcatctgggccagctccttgttcagcttatactgtacgctcatgtcgttcagactcctttgttgtttggtgtatgaacgcattatacgcccaatctgaatatgttaaaatgctcagattacaattattttgtaatgccagtttgcaagaaataaagaaaagcacggtttctgttctaaaacaaaagccgtgctttatactgcttatcagctgttatatgctgtattttcctcatcagttaccgcgtttgatgtatttggtgtggcattcagataaaccgttgcaccttcatcgacgccccaaaaaatttcggtattgttcgcatctgaaacgccggtttccaccgctaccagctgatagccttcgggcgcttccatgccgtccggaatcggcagtgtatcatcgaatggaatttcgttgccgtccttgtcaatgagcgttttggtgaatacacccgtactgccatccgccgtgtgaacgatagcggaagtcggtactatcaggcaactgtccgattcggcaactgcaattttgtaatcgaccatcatgccgctggaaatcgcctgaccttcgatagaatcaaccgtgataattgccttaaaagtcgtcagactgccctgactgcccgtgttctgactcggctccggcgaaaccgagtcaaccacaccggtgagcggcagctcggaaccatccatcgtgtacatgttcattgtcaccgtctgaccaggctctacagactgcacttcatctgtcgtcagctcggccgtaacaacggtatcgcttaggtcggaaacaacaaccagaggctcggtaccatcggtctcctccccttcttccgcgttcagtgaggtgacaacgccgtcgatcgaagccgtcatcgtggcatccagaatctcctgctgcagcttgagaatgcgcgtctgaatctcgctcaccttggcctgtgcggctgcagccgtactctgtgcagccgtgaggctgcttcgcgcgtccgaagtatccggcgctgtaacattggagatcgacataatgactgcaccgctgctgtatgtgtggttcgagccggtataggccgtgatttcaccgccgatcggtgccgtgataacctgctccttgatgtagtccagcgtgcccgacccggaagagaaaatcgtgccggcactgtcgctgttgatcgttgcggtagcactcgttccctgcgccagtgcaccggaaggattctgtacggtcaatacaacaaggaaagtacctttgccggaagcggaatcaatcgacgaaaccacagcggaaaactgtccgacagaggtagagatcgtagctgtctgaccggccttgatatctttggcatattccgaactaaactgtacagcaagctgcatctggctgtcgttgaccatacggccgatggtctgtcctgcacttaccttctgctctactgcaaatgtgcttgatgcgataaacttgccgctgaacggtgccgtagcgctgccgtgggtgtactggctctgcgccgaggcaatgcggctctgtgcctgcgtaatcgctgcctgtgcgttggtcagctcactctgcgcggcagtgaattctgcctgtgccgctgtcagctgttcgcggattccggtcggatcgacaacaaccagcggatcaccggcatgcacctcatctccctcggaaaccagcacctgagagattttgccctcaattcccaagccaagttcttccgtattgcgcgcagccgtttcaccgctgccctcaatataagtgccaatatcgccataggtaacgactgcagtcgtcggaattgtgtcctccgtgccggtattgcgcgagcgaatgacagcaaataccgaaccgccgaccagcagaataatcaatccggctgcaatgataacgcggacgcatttactttgattaaatcttttgcgaaaggattcagtagactgctctgccttctcgtttttttcgtcagcatcagctttttcggatgcttcttccggtgcagtattttcctccgtctgaacggtcttgtcagagttgttttctggcatcggcggaagcgtctgtgtctgctcaagctcctgttcattcttgtgtttgccgaagaacttcttcttgttctggctcatattttgatgttcctttctatgctctgttcctgtgaaacagagccgtgcctgatcttggaagttatctcttgatcagagcctgtaaaaagtcgtgtacttttgcgggcagttcctccagcgaaccgtcgttgatgaattccgcatcataggcgtacgctgcaacgccatcgtctgagcggttgcccagctgtccgcgtgcctgctcaagtgtcggtcgacgcacgagaatggtcttgcagtttacgcctgctgtctgacgaaaccgctcgatctcctccggttcccggatatggacgaacagcagttccgcatcattttcagcaaatatctgcagctgttctgtgcagtagcggaacggaaggtcgttgaattccgtgcagtctgccttcagctgcgaaagaaaacgacgtgccgccggtgttttggtgccgtcccatcctgcggctttggctacctgcaaaatgggtgtgatggacgaaatgttctgcaccttccagctttgcgcggcagcactgcatacggtatccttgccgacaccgccgctgccgtttatgataaacacttgtttggtcaagtaaaagtctccttcaaatgcgcatttctatacactatacattttagcacagcaaatcgacctttacaagcggacagtctttacaattctgttaaaaaagcgtgcctgtttttggcaggcacgcccgatttcacaggatgatgcaaatgagtcctcctgcgctttcattgatgatcttttccagtgtttcacggattttaccacgggcatcatccggcatacggctcaatttgtgcgacagttcctcacgcacgagttcattgagcgactttccgaaaatattggtctcccaaatcttctccggctgttcctcaaactcactgagcagatagtgtaccagttcttccgactgcttttccgtgccgacgatcggattgacctcggctttgatgttggcccgcatcatatggatggatggtgcagaagcccgcagacgcacaccataccgccctccctgccgaacgatttccggtttctcgagcgaaagctcctccaccgacggcatcacaatgccgtaaccggtctgatatacctgatcgagcgcaccatgcagccgttcgtactgctgtttcaccgcagcgaaatcctcaagcacacgaatcaaatctgcgtcatcccgcacctgaataccggtctgctcgccgacaatgccgtagaatacggtttccggtacgtccacacgcacgaccgccgagccgctgccgagcgccatattgtccacgctcgcccgctcgacgtattcgttctcttcgagggtacggcatagcttctgtacatcacgcattttctctccgtcggcggcggctgtgcgaatgcactggtaaatgctgttctgtaccggatgatgcagcggcagagtaccgatataacgaggaaggacaaaaccaatctcgcagaccggaaattcatacagcacctgctgcagaatatccgcaatgccgctctcatccagttcaagacagttcaccgcaatcggtgcaatcccgtactgcgactgcagctcgtcgcatacacgctgtgccgcttcgccgttcggctctgacgagtttaccaacacgagaaacggcttgccgagtgactgcagttcctcaattacgcgtttttctgccggtatataggcttcacgcggcagctcggtaaagctgccgtcggtcgtcaccaccagtccgatggtagagtgttcaccgataaccttgtgtgtgccgatctctgccgcttcggccagtgtcatgggatcttcctgccacggtgtagataccatgcgcggtgtatctccctccatgccgccgagtgcgccctctaccagatagcctacgcagtccaccagccgtacccgacatgcgccgccttccggcagagcgatttccgccgcttcttccggcacaaatttcggttcggcagtcataattgtccgtccggtgccggactgcggcaattcatcccgtgcgcgctcccgcttgtagggattctccatatcgggcagcaccatagtctccatgaaccgcttgataaatgtggatttgcccgtacgaaccggaccgacaacaccaatataaatatcaccgccggtacggctgctgatttgatcgtaaatctggttttccattctcttcccgcctttcagtcctgaatcggaatcagcagcatggcattctgcacacactctgcctctgtcggcaagtcattcgcacagcggatggcctgctcggtcgtaccgcagtttttggcaatgtcccacagccgttcttcgccgttgatctgcttgagaaccagtgttacgccgttatgaccgctctcctttggcttgatctccaacgcagagatatggcagaatgtcacacgctcctgtgttgcagcagcgccgtttgcggtgacagtcaaaagcaatcctcgctcacccgccgctgtggcgcgtgccgaaagcgtaagctcttccggctctccggcttcgctgtacggcatggtcagcggtacaagacgctgtaccgcgcaaagctgctgttcatcactcaaatacagcacgcgaacaccagctttgatttgcagctcgctctccgatacacgctttgcgccgcagcagaccgcctgcgcggcaatcacatgagatacatgctgtgcggtctgcaaagtctcgctgccttcggaggtaaacggctgtgcggacggcatattctgcaatacaggatgctctgcctgtgcagcaagttccttgccgggcagatacatatcctcgatgcagcgcagcctgcgctcctgccgcagcagtactattgcctgtgcgctgatggtgcaggacaacatgccatcggattccaatcggcagtctgcctcagatacggtcatccggactgcagtcagggcgtcttcttctgcttccggcagctcgagaatctgcgtgaacggcgtgctgctgttcagtacacgcacagcatcatcctcctgcatggcaagacagtgcagcacagcttcacctttcacgatgattctgccatgcattgcgcggcactcggatacctgcatcgtgcagtcggtgtgcagcagggacagctccgctgcatccgcaagctgtatatcgtccagtattgtcaccggataactgcgtacctgctccagtagcgttatgctctgcaaatggctcaggcattctatgccgtccagttcgaccgattccgtcacgtcgcattcagctttgcagtagccttcggttaaaaagcaaagctgaacgctgacgctcaccttgcggctgttcatagcttcggcatctactgcggcaatgcggcacacggtgctgcagatagattctgccgttaaaccctcacattcctcaatatgcgcaaacgtgaccggcacggagagccgacgcagcttaccaccgttttccggttcgtacagtacggtcgtctgcacggtgccggataccagcaggcggtcattctgtggagtttggtccttgatgaccgccgtaccatacgcgcacacgattcgtccgatatccggaaacgtgtccggcacaatcgaatccgcactctctgtcgccgcagagatatgcgctaatttcttttcgtagtagcagatgcttgtttgattcagttccattgatgctgcctcctttggtttcaccgctgctcctgcattaccatatgaagcgcttgcgtaaaatatgagcagatcggtttcgctttgctgtcacattttctatccgagctgcttatactggtaacaggagcgtgatgcgctatgttctgccgtggtcaggcgatcggtcttgccgtatttatgtttggaacaggcttgctgctaggcagtctgctcccatcctgtctgccggtgtggctgattgcactggcagtgatcgcggcagggctgttcctgctgcagtgctgaaggagggtaaggcatgatgaaggttgttgtatggaaaagtcccaagtgcttacgcgggatcctgtgctgcctgtttcatgtaaacagggcataagaaaaagcgcattcgcagataaatctctgtgaatgcgcttttggctgtttatggaattgttacttcttttcagtcgtgctgccgaagccaccggtgcgttcaccgtcagcctcatcgtccacggtgataccgaacggcaggaaaataccctgtgcaaagccgtcgcctgcggcaaccgatagggttttgcccttgtgatcgtcgctggtcatcttaatgagaatgtgtccttcatttttagcctcaaagtagtcgctgtcgataatgccgaccgtattgtcaagctgcagacggtgacggaagcccagaccggaacgcgggtacaggctcagcacccagccgtcctcgatcataacgcggataccggtcggaataaggatggtctcgtgcggaacaagcgtaaagctttccggcgcaaaaaaatcatagccggcagagcctttggtcgcgcggcgcggcagccggatgttctgatagaccttcttggcctcatccgcgctgcggcgggtagccgtgcaccagtcacggacaaactgttcctcggataccttgaaaaactgtgcgatctgttgcataattcagcactcctttttacttatcgtcatgcaggacgatactgttagccgcaagcgtgcgcggaacatcaatcacgcgctggttggcactgccgcgccagtgaagctgcggatcggcctgcgcctgtacaaaacgaccgtcgatcagcacgtcaatctgatcaagaaacggcagccacttgatttcctcccagcggtagccggtatacagccagatggtcttatccggaaacttttgccgaatctcgcggcacagctcgctgatctcctcgcggttgccggggaaaagcggatcaccgccagaaaacgtgatgccggagatatagtccttgccaagctcggtgaacagctcagcctttgctgcctgatcaaacagcagaccgccttctgcgtcccatgtgatggggttgtgacagccgggacaggcgtgtccgcagccggccacccacagcacaacacgcaggccgtcgccgttgagcatatcgtccttggttatattgtgatactgcattcgtgttacatactctttctttcagcaatttcggccatcttggcatcgttcaggcgcgtatcgcccttcacgcgagagtaggaaagatagccgttcattctctcgattttggtaaggttgcggctgccgcacttcgggcagacgtccatggaaagctcctcatgaccgcagtcatcgcagtacgcgagtgaaagattgacaccctcatagaagccctttgccatggcgcggcgcaccagagagcgaatcgcttcatggttgtagtcaatcgggtacttgacatattggatcttgccgccgttgcacagattccagaaacgcccctcaagatcctgcttctgaattggtgtcaggtcctcggtaacgtggcagtggaagctgttggagacatacggacgatcggaaacaccctcgatgatgccgtatttcttgcggaactgctcgacctgcaaaccgcacagactctctgccggtgtaccgtagatagcatacagattgccgtcctcgttcttgaactgttcgaccttatcgttgatatactgcagtgtttcgagggcaaactgaccgtcctcggcaagcgatttgccgttgtacagctcctgcagctcgttaagtgcagtaatgccgaacgacgcggtagcggttttcatgatcggcttgatcttgtccgacggcttgagatgtccgccgtagaaaccgccctcgcagtacgccagcggattggtagatgcacgcatctcccccaggtacgcataggtgcggatatgcagcttgcggatgagctccagataatagtcgagcacctcgtggaacgggcggttctcctgctgagccttggcgtagatcatcggcaggtgcagcgacaccgcgccgatgttccagcggccgacaaataccggcttgtcatcctcgtctgcgggcttcatgccgccgcgctcgaaccacggagaaaggaacgcgcggcagcccatcgggctgacgatcgcgccgtactttttgtacatactcggcacataaccctcgccggtgagcgaaagccagtccggatacattgcgcgggacgagcacaggatgccggcttcaaatacgtcctcgagcggcttgccgggaccgtgcagattttcgtcatacagaaatacgatcttcgggaacagtacgggcttcttctggccctttttgccctgtcccttgcggcgtacgttcagcatggtgatggaggccagctttgcgaagcggcccgtgccggtgcccatcgtcatagtgatgaacggatagtcgccgcggctggatgctaccgtgttgaacttgtattcccagccctggaagccctgctcaaagtcgttgagaatatccgccatgacttccttttcgaccgtatcagcatccagacccagacgagtatacttctcggtcatcattttgtagctgcgctcggcatacggctcgagcagcagatcaaccgacggcacggtaaagccgccgtactgctggctcgccgcagacagcacgatatcgccgatcacgtcaaatgcaacattaagtgttttcggctcgttgtaccacagattgcccatctcaaagccgtccttgaggacactcgctacatcaaacaggcagcagttcatggtatcgcggcgcgctgacatatcgtggacgtaaatgtagccgtcccgacaggcctgcagttcctcggtgttcataaagaacttctggtacagctccttattgagctgattgaagatcaggctgcgcttggtggagaccagcgcggaatccgtgttggaattttccttatcgccgatatacatgatggactggcttttctggtatacgctgtccagcatgccgacaaaatcctgcttatagttgcggtagtcgcggtagcttttggcaacctccgggcgcaccgcctccagcgcggactcgacaatgttgtgcatttgccagatctgaatctcggtcatgtgatggtcacggatataaccctcgacatgattgcagatcgacttcagctcatcctctgtaaagttgtagaggactcggtttgccgacttattaacggcgataacaaccttctggatgttaaacggttctttggtgtgatcctttttgacaactcgaaccatgtgttgttcttcctctctaaatttcatacgttcattattatatcatattgtccgacaaaaagcgaacaaaaaagcactgccgtttacaggcgaagtgcaaaagcacatacccatacatcatgtgctgctattgcattgtaccatacaagatatagatttggaaggataaaattcgacaaaaatatcatacatatttttgcgaaaataattctttgcataaaatcgtcggttttgcttgcgggtctgccgactatcctctataatagaggtagcgatcctgacagtaagcctctgcgtccgcagattctgcatgaaaggagccgtccacatcgtattgcagcgtttcctgcacggaagcgccgtttatatctgtaccggactgcgtctttcagaggacgcagttattttttattccgaggtgtttttatgcaaacaagagttgccgtaatgggaatcgtggtagagaacacagattctgtggaacggctcaataccctgctgcatgagtacggcagctatatcatcgggcgcatgggtattccctatcgagcgcgcaatatcaacattgtgtccatcgccattgatgcgccgcaggatgtgatctcggctttgtccggcaagatcggcaatctggacggtatcagcgtcaagaccgcatactccaatgtgcagagcgatgaataaggcaaagcagctcattgaccggctggaagcgcagcacagtctgtcaatagaggaatatgaatatctgattgaaacccaaagcgacgaactggcggcctatgccgcggagaaagcggttgctttgcgaaaacaggtatacggtacggatgtgtacattcgaggactgatcgaaatcggcaatatctgccgcaacgactgttattactgcggtatccggcgttccaatcccgcatgtgaccgctaccgactgaccgaggcgcagatactggactgtgcccgggaaggttatgcgctcggcttccgcacttttgtcatgcagggcggcgaggacagcgcattctcagtcgatgtggtttgccatctggtacgacagatcaaagccgagtttccggactgtgcagtaacgctgtcgctcggagagttccctcgtgaagcctatcaggcgatgttcgacgcaggcgcggatcgttatctgctccgtcacgaaaccgccgataaggcacattatgaaaagctgcatccggcgcagatgtcgtttgacaaccgcatgcgctgccttcgtgatttgaaagacattggctaccagaccggctgcggctttatggtcggctcgccgtatcagacggcgcggacactcgctgaggacttaaagttcatcgaagaatttcggccggagatgtgcggtatcggcccgtttattccgcagaaagacacaccgttccgcgattttccggcaggaacgtgtgagcagacagtgtatctgctgtcactgctgcggctgatccagccgaatttgctgctgcccgccacaacggcgctcggcactatccggccggacggccgcgagcgcggactgcaggctggtgcaaacgtagtgatgcccaatctgtctccgcttggggtgcgaaaaaaatatgcactgtacgacggcaaactatgtaccggcgaggaggctgcacagtgcatcggctgcctgtcgcgccgtgtggcgtcggtcggctgccggattgttaccgcacgcggagatattatccgataagtgatacattttaagggactctgacggaaagagtaatcttctgaccgcaagataagaaaggaaaacgaaaaaatggctcagtacaacccgaaatcactccatgcagaggagtttatcaaccatgaggaaatccttgaaacgctgaaatacgccgaggagaacaagcgcaacatcgagctgatcgacagcattctggaaaaggcccgtccgcagaagaccgccaccggcgtacactgtgccggcctgacgcaccgcgaggcctccgtgctgctggcctgcgatattcccgaaaagatcgaggagatgtatcagctggccgaggagatcaagctggcgttctacggcaaccgtattgttatgttcgcaccgctgtatctgtcgaattactgcgtgaacggctgcgtttactgcccgtatcatgcaaaaaaccgccatatcacccgtaaaaagctgacacaggaggaggttgctcgcgaagtcatcgctttgcaggatatgggtcacaagcgtcttgccattgaggccggtgaggacccagtcaacaacccgattgagtacattctcgagtgcatcaacaccatttactccatcaagcataaaaacggtgcgattcgacgtgttaacgtcaacattgcagcgaccacagtcgagaactaccgcaagctgaaggacgcaggcatcggcacttacattctgtttcaggagacctaccacaagcagagctacctcaagctgcatccggcgggcccgaagcacgattacgactatcataccgaggcgatggaccgtgcgatggacggcggtatcgacgacgttggtctgggtgttctgttcggtctggagatgtacaaatacgagttcgccggtctgctcatgcacgccgagcatctggaggctgtacacggcgttggcccgcatactatcagcgtgccgcgtatcaagcgcgcggatgatattgacccggatgtattcgacaacggcctgagtgacgagctgttcgcaaaggttatcgcgtgcatccgcattgccgtgccgtacaccggcatgatcatctccacccgcgagagccagcaggtgcgtgagcgggcgcttggtctgggtatttcgcagatcagcggtgcttcccgtacctcggtcggcggctatgaagaagaggagcgtccgcacgactctgagcagtttgatgtatccgatcagcgctcgctcgatgaggttgttcactggctcatgcagcttgggtttattccgtcgttctgcaccgcctgctaccgtgaggggcgcaccggcgaccgtttcatgagcctgtgcaagagcggccagatcctcaactgctgccacccgaacgcattgatgacactcgcggagtatctggtagattacgcaagcgaggacaccaagcgcgttggcatggagctgattcaggaggaacttaaaaaaatcccgcgcgataaggtacgcgaaattgcagccgagcatatcaaggatatctgcagctccaaccgccgtgatttccgcttctaaggagggtttcctatgggactgaacgcacagccctccggcgagcgcgtacacatcggctttttcggtctgcgcaatgcgggcaaatccagcgtggtaaaccgcgtgaccggacaaacactgtccatcgtttccgatgtcaagggcacgaccaccgatccggtgcagaaggcgatggaactgctccctatcggtccggtggttatcatcgacacgccgggcattgatgatgagggcacgctcggtgaggaacgtgtccgccgggcgctccgcgtgctggaaaagacggatattgcggttctcgtcacggacagcacgcgcggtttgcagcctgccgagcaggaactgcttgagttgtttcgcaagcgggaacttccgtttgttatcgcccataacaaagcagatttgacgtccgttccggcttctgtgccggaaaacgagatttacgtcagcgcagcagccgacagcaacatccgtgaactcaaggaactaatcgcacgagccgtcaagccgactgagccggaaaaacgtctggttgctgacctgcttgcgccgaatgacacagtcgtactggtcgtgccgatcgactcagccgcaccgaaaggccggctgatcctgccgcagcagcagaccatccgcgatattctggaagcaggcgcaatttcgcttgtcacccgcgaaaccgagctgacccgcacgttggaatccctgcgtgagccgccgcggctggttatcacggactcgcaggcgttcggcattgtggacaagctggtgccgaaaaatgtccagctgacctcgttctccatcctgtttgcccgatacaaaggcaatctgcggcaggcgattctcggtgctgcacagctgaattctttgcaggatggcgatattgtgctcatctccgaaggctgcacgcatcaccgccagtgcggcgatatcggcacggaaaaactgccgaactggattcgcagatttaccggcaaggatgtgcagttttcatttaccgcgggtaatgagtttcctgaggacgtgagcaagtatgcacttgtcgtgcactgcggcggctgcatgctgaacgagcgggaaatgcagtatcgtctgcggcacagcgccgagcggaatgtgccgatgaccaactatggcattgccatcgctcatatgcacggcattctcgatcgtgcgcttgctccgttccctgatctgcatcaggcatggagcagcaccgcaaacggataaaacatggggcgcgctgaaaacagcgcgcaagaaaagacgagtaagtttctccgaatggggtttgcttactcgtcttttttgctttagattaagatgtgaaacaacaccggtgcagtgtaaatgagtgcagggacaagaagccttcttcagacttttgcccctgtattctttgcactttttcctgcttacattttgaaaaattgaaatgcttggcctgcgtcgggaatgcaccgcagttcacgcatgccagttctcccaatccgcaatgcggtgctgcagcggaccggaaccgtgaccaagatccagcttgaagtcaatgcaggcggtcagataccgcttggcccgcttgacgctgccaacgagcgacacgccatgtgccagtccgcatgcgattgcactggatagcgtgcagccggtaccgtgcgtgttcgggttgtcaatacgcggcgcgggaagccagcgcatttctgtgccgtcaaacagcagatcatctgcgcagtctgccagatgaccacccttgaccagaacggcaccgccggtcttgccgacgatttcgcgtgccgcctgctccatatcttcacgattggtgatgttatggctgcagacagcggctgcctcatgcagattaggcgtgaccagtgtgcacagcgggaacagctcctcctgcagaacctttgccgcattgtgatgcagcagcgcggtaccgcttgaggacatcattaccgggtcgagtacgatattcttggcgtggtacgccttcaagcgctccgctactgtgtgaataatctctgcgtcatacagcatgccgaccttgacagcatccgggaaaatatcgtcaaacacacagtcaatctgtttgccaaccagttcagcggaaaccggctgcataccgaatacaccagtggtattttgtgcacacacgacagtgataacggccatgccatacacgccgaaggcttcaaaggttttcaggtcggtctgaatacctgcgccgcctgtcgggtcggtgcctgcaatgctgagaacggttttcatgttaattttcctccaatcctgtgccgtcaaaggcgggaataaaactctcgctgatggattcgtcctgctgaaaaaaaccgccgagtccaagctcaccgaacagcgtacaggcatctgcgtactcctctgcggtgatggtgcggtcaagctcgggataatcctgcatatcaaacggcgtgtactgccgcataaggctgacaagcacgctgtcgccccatcgagaggcaatatcccgaagcacctgcgctgtgtcgccggccagtccgggcagcatcaaatgccggatgacggtgccgcgcttcagcagaccatttttatcaaactgcggtgcacctgtctggcgcaccatttcatcaatagtcggaacggcgaactcacggtaatcctccgcatgcgagtacagacctgcatagtagctgctataatacttgtaatccggcagatagatgtcaatgtgaccatcgagcagctgcagcgtttccacctgctcatatccgctggaattgtatacaacaggaagcgaaagcccctgttttcgggcaatttgcagcgcttcgataatttgcggcacataatgggcgccggtaacaaggttgatgttatgcgcaccttttttctccagagagagaaaggttttcgccagtgcatctgccgtaatgttctgtccctcggcctctctgcggctgatcttgcggttttggcagaacacacagccgagcgagcaatgagagaaaaacaccgtgcccgagccatttgtacccgaaatcggcggctcctcccacatatgaagcgatgcacgtgcagcttcgatttcgatgcctgcaccgcaggctccgcggctctttgtgcggtctgcgccgcaggcgcgcggacacagctgacagttcttaagcatatcggtcaaaataatccctccgatacgttatattatatcgtatttttgtctggaaataaagtagagaaatgtgatataataaacactacggctttggaacgtatagaattttcacgcggatcaaaatcgtgtctttttattaaacagaaatacgagtagaaacataggagatgcaacatgaaggtttcccaacttttgaatcaggataaagtaaccctttctttcgaggtattcccgcccaagaccagcagcagctatgagtctgtcgcacacgcaacacaggagatcgcggcgctgcgcccggactttatgagcgttacatacggtgcaggcggcggcacaagcgaacacactgtcaacatcgcggcagatctcaagaagaagtatgatgttaccgttctgacccatctgacctgtgtttcctctacccgtgagcacgttgcagcgatggtaaaaaagtataaggatgccggtatcgagaatattcttgcgctgcgcggtgatattccggagggcggtgctccgcattctgactaccactatgccgctgaactggtacgcgatatcaagtcgcagggcgatttctgcgtcggcggcgcctgctacccggagggtcacgttgaggcagccaataaaaccgaggatattctgcacctcaaggaaaaagtagacgcaggctgtgaatttctgaccacgcagatgttctttgataacaacatcatgtacaacttcctgtaccgtatccgagaaaagggcattacggttccggttgttgcaggcattatgccggtgacgaatgtcaagcagatcaagcgtatcacttccatgtctggcacctacctgcccgaacgcttcaaggccatcgttgaccgtttcggtgacaatccggcggctatgaagcaggcaggcgttatctacgcgaccgagcagatcatcgacctgattgcaaacggcgtcaaccatatccatgtttactcgatgaataagccggaaattgccgcaggcattcagtccagcctgtcggagattctcaagtgattgaactggacagatcggaagccatccgctacatgggttatcacggcacgcagccggatgaggctgtgcaggccagcctgacacgatgcggtgaagcactgcagcaggcggcggaacccaagtcgatctaccgcgtgtttccactgcagcatattgacgcgcaaacactcgagatcgcagatgtacaaattcacagcaaaaatctggcacgcaatctgcagggctgcagcgaggtctgtctgatggcagcaacgctcggcatcggaccggatcgcctgattgcccgcgcgtctgcagttcggatgagcgacgcggtgatctatcaggcggcggcagcggctatggtcgagacctattgcgacgaggtcaacgaacgcatccggcaggacgcagcgcagcgcggcatgtactgtcggccgcggttcagtcccggttacggcgattttccgatcgcacaccagcgggatttcagccgcctgctggatacgccgcgcaagattggcttgaccgtgaccgaaagctgtctgctggcacccatcaagtcggtaacggcggtgattggtctgtctgaaacaccgcagccgtgtcaccgcaagggctgtgaggaatgcggcaagacggattgcgcttacaggagatgaaaagaatgaaactgaccgaacgactgggaaaagaatggatatttttcgatggcggcatgggcaccatcctgcaggagcacggcttaaaagccggtgaactgccggaaacgtggaacctgtcccatccggatgagattattgcgctgaaccgcagctactttgaagccggctgtgatgtggtgaacaccaacactttcggtgcaaatgccctcaaatatccggataacctgcaggaaatcgtacaagctgcagtttcgcatgcaaaaaccgcgcgtcagcaggcaggccgagaggatgcctatattgcgcttgacatcggtccgaccggcaagctgctccagccgatgggcgatctgccgttcgagcgtgcggttgagctgttcggagaaaccattcgcatcggtgcggcggcgggcgcagacctcgtgctcatcgaaaccatgagcgacagctacgaggccaaggcggctgtgctggctgccaaggaaaactgcgacctgcctgtgctcgtaacgctgattttcgacgaaaaaggcaagctgctgacaggcggcacggtggattccacggttgccatgctcgagggcttgcgcgtagacgcgctcggcgttaactgtggtcttggtccgaagcagatgcacccgatcatcgaacgactgacgcaggtcagctcactgccgatcatcgtcaacccgaatgccggtctgccgcgcagcgaaaacggcaaaaccgtgttcgatattgcgccggaagagttttccgacctgatggaagaaatcgcaggcatgggcgtacaggcacttggcggctgctgcggcactacgccggagcatctgcggctgaccatcgaaaagtgccgtaaggtaccgttccgaccgccggtagccaagcgccgcacggtggtctcctcgttctcacaggccgtggagatcgggccgaagccggttatcatcggtgagcgtatcaacccgaccggcaagagcaaattcaaggcagctctgcgcgagaataacatcgagtacatcctcggtgaaggcatggcgcaggaggacagcggcgcacatatccttgatgtcaacgtcggtctgcctgaaatcgacgaacccgtgatgatggagcgcgttgttacgcgcctgcagagtgttatcacgctgccgctgcagattgacacctcggataccatcgcaatggagcgcggcatgcgcctgtacaacggtaagccgatgatcaattcggtcagcggcaagatggaaagcatggaagccgtgttcccgcttgtacgcaagtacggcggtgttgttgttggtctggcactggatgaaaacggcattccgtccacggcagagggccgcatccggattgcaaagaagatttacgatacagcggagaaatacggtattccgcatgaggatatcgtgattgacggtctggcaatgaccatttcgtcggacagcggttcggctctcgtaacgcttgaaacgctgcgccgcattcgtgatgagctgcacggtcactcgattctcggcgtatcgaacatttcgttcggtctgccgcagcgcgagattgtcaactcgaacttcttcacaatggcgatgcagagcggtctgtcctgcgcgatcatcaacccgaataacgaggcgatgatgaggtcgtatcgttcctatctggcgctggccaacctggatgagcagtgcgcaggctatattgcggcctacggcaaccagccggcagcggctcctgcggcagcaggcggcacggcgatgccgcttgcggagagcattgaacgcggcctgcgtgaacgtgcgatcgacgcggcaaaggaaatgctgcagacggttccgccgctcgaggttgtcaacaacgagctgattccggcgcttgaccgcgtcggcaagggcttcgagaaaggcaccgtgttcctgccgcagctgctcatgagcgcagaagcagccaaggcggctttcgaggtcgtaaaggacgcgatgaagggcgagagccagcagatcaagggcaaaattattcttgcgaccgtcaagggagatattcacgatataggcaagaatatcgtcaaggttttgctggaaaactacgcctatcaggtgcttgatctcggcaaggacgttccgcccgaggtgatcgttgataccgctatcaaggaagatgttcctgtggtcggtctgagtgcgctgatgacgacaacggttgtcagcatggaagagaccattaaacagctgcgtgagaaaaagccagacaccaaggtcgttgtcggcggtgccgtgctcacacaggaatacgcagattccatcggcgcggactgctacgcgaaggacgctatggcaaccgtgcattatgcggattccatatttggcgtataagataagaaaaagagactgtatcaccgatacagtctcttttttatgaaattaagcggcgtcttcgagttcttcaagcgcctcctgtttggtgtcggcagagaaaagaaacgcgccggttccgtcatatacttcaatgtgtccgtttacatattcgagagtgcagttcatcttgcgcatcccctttccttttgttgtacatagtataacaaaaggaaagtacgttaaacggtacttagtctatgaatttgtgaatctgcttttcaaacgcttcgcagacctccggcgggtttacaatgcgcacatcgccttccagactgaacacccaggaaaaaaactgcggactgacgacaacatccacatccagataaaaatgctcgttatccgccggaaacagacgcagactgctgccgaagcggtcgagcatgacaccgataaagcggttcaggcatttcagcttcacggttttctcctcgccggagaacatgccgaataccttgcgggagtaggctgccgcgtcaaaccgatcgtcgaacagctgtttaccctcacgaggcaggtcggtctgcacaagtgaatccatcttatctacgcggtagtggcggatttcatcggcatcgtgatcgaaagcaatcagatagtaattttcattgtcccacgtcagtgcccacggactgacgcggtagcgcgcaccatctcggcggtactgcttttgaatacgcggactggcagagaaattcagcacccagttgaaatagcgaaacgtaatctggacatcgttggatatggccgcatgcagcgcatcaatattgtagtaaatctgctcattaagcgttttcacacgttcggaaacatacacctgacgttggagcgtatgtgcttcatggtcactggtgaggtgctcgattttgccgatgagctcgttggattttttctcggtgataaagcgggagcactgaattgcatccacgagcagcttgagctcgggcagttcaaactcgcgcgacgcgacgtaatagccgccgccggtacctctctgacaaattacatccagaccaaaattctggagtgcttcgatgtccgaataaatacttttgcgctcagcggtaatgccgcagcgctcgagcgccgcacgcagttcatctgtggtgagtttatggttctcatccgttcgctgcagcaggatttggtataaatacagcagcttcagcttttgattcggatttttagacatggttagcctcccattcagaaagcgcgttttgatacgccgaaagcgtggttccatcaaagcagatcatgcttacctgctcaatttctgcatgagttgaaagatattcctcaatcgtatggatagcgatttcagcggcacgattcagcggaaagcgatacacaccggtgctgatggacggaaacgccacggttttgcaatttaattcggatgcaatgcgcaggcagttttgatagcagcctgccagcagtaccgcctcacccgcatgtccaccgcgccagatcggtcccggcgtatgaatgacataccgacatggcagacgatatgctcgtgttgctttggctttgccggtccgacagtcgccgagcgtgcggcattccgccagcagctccggtcctgccgctcgatggatggcaccgtccacaccgccgccgcccagcagggacgtgttggcagcgtttacgatcgcatctgtcgtgcattgggtaatatctccgcgctgaataaaaattcggctcatcagccatgccccttccatgaagttgttggctttattatacgttgtttttccgaaaattgcaagtttgacgcaaattgcagaatgcgttataataaatacagtatcacagcaggcgaggagagcgcagtaatggacaagccgatgaacgaatacgccgcagacgcaccgcgcgttttgcgggattttttaacctatatttccacaatacgcggcaaatccgcaaaaaccgcacacgagtattatcttgatctgcggctgttttttcgcgtactcaagcacaacaaaggcgcagtcgataaaaatcttccgcttgatgagatcgacatcagcgacattgatctggattttatccgtgatatcacgctgtcggacacctatgattatctggaatacatggcgcagagccgcccaacgcagcagaacagcaaccacaccaattacggattgagtgtcaattcgcgtgcacgcaaggtctctgcgatacgcgcatttttccggtatttgaccgataaacagcatgttttagaggtcaatccggtcagcggactggaagcgccgactgtccgtaaatctctgccgacttatcttacaacggacgacagcgtgcggcttctggaatccgtcaccggcccgtatgccgagcgagattactgcatcctgacgtttttccttaactgcggcatgcgtgtttccgaactggtcggactgaatctgaccgacttcaaggacgataccgtgcgcgtgctcggtaagggcggcaagcagaggacggtatttctcaatgatgcgtgtcttgccgcacttgagcagtatctgcccaaacgcctggagccgaacgagcaggacgcggacgcgctgtttgtcagcaaaaagcgcaaccgcatcaatgtgcagacggtcaagtggctggtaaagaaatatatcggtcaagccggactcgaccccaaaaaatactccgcgcacaagctgcgtcacacagcggcaacgctcatgtaccagaacggcgtggatatccgcacactgcaaagcattcttggtcactcgagtgtggatacgaccatgatctacacccacatcgagaatgaaaacatgcgcgaagctgcggcaaggaatccgctggcggaaatccggccgaacggtgagcgtgtgcctgtaaaacagccgaaaaacagcgataagtaacataaaagggcgcgctgcaaaatagtgcgtaagaaaagacgggtaagtttccccgaaagggattgcttactcgtctttttgctttatgattaggtgtgaaacaagatcaaaccacctattttcgaaaacaaacgcagggacgaaatgccttatgcgacctttcgtccctgcgttctttgcggacctgttctgcaacagactctttgtttattacagctgcatctccagcgcggcatcacagtacggacagcggtcaccgaccttgccgtgcagcggtacatacagctcgcttcgcgtaatgcacttgtggttggagcagcggataccggaatctgcaccgatttcatgatgaccggcacgctcgaacggcagcttggacagcgtcagcagcagtgccatacggccgaacatgccgaaccgcgcctggcggaagtagaccgcacgcggatcatcatccacgtcctgtgcaatctcatcaacacgcggcagcggatgaagcaccagcatgtccttcttggcgcgcttcatcttctcagctgtcagctgataattgccttcaaggtttgcgtactcctctgccgtgacaaagcgctcgcgctgaatgcgagtcatgtacagcacatccagctcgggcagaacttcatcaatgctgtctacctcgcagaacggcatattgttgtctttcaggaattttaccatatagtctggcagcttgagtgcatcaggtgcgatcagataaaactgcacattatgataccgctgcaggaaatgcagcagagaatgcacggtacggccgtacttcaaatcaccgcacagaccaatcttcatatcgtcagcagagccgcgcatacgcagaatggtaatcatatcggcaagcgtctgggtcgggtgcagatgaccgccgtcgccggcattgatgacaggcacagacgagtacattgacgctaccttggctgcgccctctcgcgggttgcgcatgacgatcatatccgcatagctggataccatgttgatagtatccttgagtgtttcgcccttagacgcagaagtggcgttcggatcggaaaaaccgacaacactgccgcccagtctcatcatcgcggtggaaaacgacaggttggtacgggtagaaggttcataaaacaggctgcccagcaccttgccgcggcaggcatctacataaccctccggtcggtcgataatattgctgaccagcttgtacagatcggaaaattctttttccgttaaatcacataaatcaataatatggcgcatgcaaactccattcctttctacagtacagtcgccctattcgttatttgtcactgttaatgatagcacaaataaaggtgaaagaaaagagttatttgcatattgcgtcgattggatcgagagcggccgcacgaaccgccgggagcagtccggcagcggctccgctgagtgtggaaagtgtcagcaatccggcaaacacgcggccttccggcaggagcagtgctgctccgaagtgcaggagcgcacctgcggctgccagaccgacgattccgccgaacaggcacagcagcacagcctgcaggagaaatgtccggcgaatatcatgcggctgtgcgccgagcgccagcagaatgccgatcccccctgttttctcgtgagcggcagccagcatgcttcccataacaccgatgagcgcgacaaacagtgtcaccgcaccgacggcagcaaacaggccgattcccatttcggcaagctgctgtacggtctgcaccgcacccgacatattctgtacatgcacgccgcgtacctgctgtcgatcggtcaggtacttttcgatctgagagctgaccgaagcagtatctgtctgcgaaatgcactgcacgaacacttgatccgtgcgttcggtttgcgacgcgatacacgcatacggcacatagaccagatgcggcgcaaccgccgacagcattccgccgaatgcccccgtctgtgcccgcacaacaccgcataccgtgaaataccggtcggtgccgtttacctttagccgaatctgccgtccggtgatatttgtccgtctgtacaacgtctgtgccagatcatcgccgaccacggcgaccggctcagcgtttgcacactgccatgcgttcggcagtgtgcctgccagcatctccatttgcatgacttcaccgagccgttcgtctgcaccgagaagtaccgcgtgctcagttgtgtgtccaacgcgcacggtgccgctctgcgccttgatcggcatcagcgtgcgaatgccgtccacatcctgctctatctcatccgccagtgctgccgagagtatcgttcccgcgtgtccgctttccgtgtacaccgataaaccgctgacgccgagtgtctgcaaaccgacgtccacctgttttcgcccatacagaccaatggaaaggataagcagcagtgcaccgcttccaaccgcaacagaaagcgcgcaaagtgccgtccgcagcggactttcccgcagattatgtgccgccagtgacagaatatcccgcagtctcatgtctgtacctccaccggatcaccgtcagtcaattcatcgggcggcgacagaatgaccgatacacctgtcggcaagccgtctataatttcaaccgtatcctcgagcagatagccggtctgtaccgcgcactgcacggcatggccgtcctgcacgcagaatacaaattcttgttctccgcgctggcaaattgcttcatatggtacaaccgcagcatcgtctcgatggtctgtgaataccttaacggtcgcggaatatccggggcgcagattttcggttgagccgttcaaatcaagcagcacctcaacggttgcttcggcatcttcgtttgtcagactaaaggttttcacagccgcaggagcaattgcggttaattcggcgtgaaaggtaccgtccactgccgaaaatgtgatgttagcgcgctgcccgacagcaagctctcctacatatagctcgggagactgcgcacgcacgcgcagcttatccggatttgcaatttgtatgcacggcatatcggccgatacactctcgcccgcctgcggaacggtcagcacagtaccgtccatcggcgcatacagcgcgtgagcgtcctcggcagtgacagtgttcaccgtgccggaaattgcaaacacgctctgtgcggtctgccagtaatccgcagctgtttgcgatctgccgatgtcagtcagcgtgcacagaatatcacccttctgcacggtgtcgcctgttgcggcatacactgcacttactacaccatttttcgccggacaaactgctgtgctctctgcggactcgaccgtaccgaaaatcgtcacactattgtagatatcctgcgtttcggcggccgctgtgcgtaccaaaaccgcctccggcggacggtgcttccacgaccagaacagcattgccgtcagcacacctgctgtcataagcagcaccgcgcggatcttattctccaaatgcaaaacctcccctgacgcaaactgagtttagtctgcggagaggaggtgaaaattatgcttacaatacggcacgaattgcgtcaccgacggttttcgcacgcacgatattcattttctgcagcaggtcctcgtctacatcctgcataggcatgatgcaggtgtggaaaccaaggcggtatgcctcattgatacgctgtcccggattggacaccgcacgcagctcgccggtcaggccgacctcgccgaagctcatgacgccttccggcagcggcttgtcccgaaagctggatgcgattgccagcaccatcggcaaatccacagcaggctcgtccagccgcatgccgccgacgacgttgacgtacacatcgctcgacgacagaaacagcccgcagcgtttttccagaatggcgagcagcagcaccatgcggttgtagtccacgccggcagcggtacggcgcggcacaccaaactgcgttttcgcagcaagcgcctgcacctcggcgagcagaggacggctgccctccatcacgcaggcaatgcagttgccggacgcaccctgcggatgaccggccagcatagccgcagacggattctgcacctcgagcaaaccgtgatcgctcatttcaaacacgccgatttcattggttgagccgtagcggtttttcgccgcacgcagacagcggaacggacctgcggattccccttcgaaatacagcacgcagtccaccatgtgctcaaggattttcggacctgccagcgtaccctctttattaacatgaccaacaataaaaatcgtcacgttgcgattcttcgcgtactgcatcagactcatcgcgcattccttgatctgggtcgtaccgccgggagcggcagttaaatcgcgcttatagaccgtctggatagagtccacgattagaatatccggctcgagcagctcggtttcgttgatgatctgctccatgtcggtctcggcaaggatgtacagttcgggtgaagaaatgtgcaggcgtgccgcacgaattttgatctgcttgagcgattcctcgcccgaaacatagagcacgcgggcatttttgcacatttcctgacacatttgcagcagcagcgtcgatttgccgatgcccggctcaccgccgaccagcacaaacgagccgtgcacagcgccgccgccgagaacgcggtcgagttcaccgatgcccgaatggaaccggctttcgtctccggtatcaatatccttgagcagagtcggccgcgattcgccgcgctgaaatgtattcgtgccgcgtgccgccgaaaccggcttctccttgaattcgctcatggtgttccatgcgccgcaggacggacatttgccgtaccatttcggactttcatatccgcagtcaccgcacagaaaaactgtcttttgcttcatatttcctccgttacataccgctctggctgcgtaaatatccgcagatcacggcggcagcaagttgtttgtgataggcttcgtcccgcagccgcgcttcttcggccggattggacagaaagccgcattcgatgataaccgccgggcagtccagctttttcatcagatagatggcgctgtctgcctgtttagccttgcgatgattcaatgggtcgcagccgtcaatcaggcactgctgtatctgctcggccagcggcttgccctgcacattccctgtcgagtaaaacacctgggcgccgtggtactgcgcgtcgctgaatttattcaggtgaatgctcagaaacaccggtgacggaatgctgtttaccagcttttcccgtgccttgatatctgcgattttgttctctcgcaccgtgcgggaaggattgtaatcaagtgcattttcatccggccgcgtcatagcagtcggcacaccgaagaaattcgccagcacctgcactcgctttgcgatgctcaaattgatatcttgctcggcggttccatccgcgccgaccgcgccgccgtcgaagccgccgtggccggcatcaatgacgagcgtggtttgagcgttccctgccgtctgcattgcacgggttttctgctccatgccaaagcacagcaccagcgccagtgccgccgcggcgcaaacgccgcatttcagccgtctctccatctccgcacctccgtatcacacaaatatgcgaaaaaggcggaacttatgcgtttacttgggcgcgttcagcacagcatctgcaccggttttgtccagtgtgctgatgataacaggctctgccgtcatgccgtccaacgtgaaggctgcggaaacactctgcctgcgaatcgcaccgccgctgaccgactgtgttaccgtggtcggctgcagccggacggcttcgtctaaatcacccattgcactttcgaccgaccagagcagttcggtgtacgcgttcggcgtatcggcacagataatggtccagctgcctgcacgctgactcagcgaatcgacacataccagcggtacgcggccatacatcgcggcaaggccctcctgctcagcggcagtcaccagctctgccgaccacgagccgttcagcttgtgatacagcgcaccgtccgacagataactctgcgtcagcagctgcttatccgatgtattcggtgcggaaagcgtcattttgcggtcggtgagcagttcgttcttctcgcggtcgaacacggtggtctcgctcgtctgcacctgcatgaccgtcctgccgtcatgggtcacagccgccggagacgcaaactcgctgttgaccgagtaatgcagcagagcatccataccggcggttgcctcgcggtactgtgcatagcttgaaaacaggctctgataccgcttcgcgtccgcttcggttatcgcgttttcgctgacaagctgatcgagcagcgtgccttcactgtccttcggcgaaacggacagcacagtgtagcttgccgctgcagcatcgtcgcgcaggaaattctgcacgttgatgataccggtgtcgtaaataccctgctcacgagcagtctctatcgcgttcgcatagctgaaatccgctgtatccgagtagccgagcgcacgcagcaggaacaccgcgtacatctgcgcggtgcacttgccggtcggatggaaggtcgtccggttcgtgccattcgccagaccgttgctgtacagatactgcacatacggcttttcccatcccttgagatcggtaaacggcgcggtataggtcagcgccttggcctcagcctccttgccgagcagacgcaccagcatgacagccgcttccgctctggtcggcgtgcggtcgaggtcgtagccgttctgcgtgccctgaaacagccccatttcgtgcagtgaatctgcacaattcgtataatttgccgcaaaggccgaagcggtcagcatggcagcggcagccgcgccgacgcagacagcgcgtaaccatttattcatagtcctatcctcctgaaactgatattgcctataaaaatacagtataagtatagcacaaagccatgtgttttccaacaacaaaacggatatactactcgcagaaggagtgtatccaatatgacgaatattcaaaaatgcggcgtgatcggcgtgggctttgtcggcgcgacctgcgcatacacattggcggtttccggactgttctccgatctggtactcgtggatatgaaccgcgacaaggctatcggtgaagctgcggacatcaatcatggtgtggcgttcagcaagccgtgccgcgtcatggccggagactatgctgacctcgctgaatgcggtcttatcatcattgcggcaggcgcaaaccagaagcccggcgaaagccgtttggagctgctcggacgaaataaaggcatcctgtcctccgtcatcgcacagcttacggcagtcaatcgtgaggcgattctgctggttgtgtccaatccggtcgatgtgctgacctgtctggcgcagcagctgagcggcttccctgccggacgtgtactcggttccggtaccgtgctggataccgcgcggctcaagtatctgctcggacagcggcttggcgtggacagccgcaacgtgcatgcgttcatcattggcgagcacggcgacagcgagctggcggtatggtcgagcgctaatatctccggtgccgatctggacgattactgccgcattgccggcattaccaaaccggcagatgagctttcccgcatttacgagcatgtgcgcgatgcagcgtatcagattatcgacagcaaaggcgccacctattacggtattggcatggcagtgcggcgcatcgcggaggccattgtacgcaatgaacattccgtgctaccggtcacttcgatgatttacggacactacggcgtggacggtatttgtctgggtgtgccgaccatcgtcggacgaaacggcgcggaagctgtgctggatattccgctctccgaggaagaactggcacagctgcagcgttctgcgaacacaatgcgcgagatgatcgacaagctggacggataacacaaaagggacagagccaatgctctgtcccctgttctatatgcgtatttttagaagtcgaggtttaccataacgtcggaaacatccggcttctctgcaatcagaccctggtcgtacatccagtcaatattttcctgccagcactgctcggtctgagagaggaacttcgcgtcctcggtctccatgagcggcagcagcgtctcacaggacttcttctctacatccgggtcgagtgcaaagtttgcctcatcctgattgtcgagcagaacctgcagaacatcgtcggtgttgctcttaaagtcctcaaagcccttgctgcaagcgcgcaggaagcccttcagcgtatcggaattgttcgcaatcatatcatcgcttgcgaggaaaataccttcgtaatacttcggcacaccgtaatcatccgggaagaagtaattgacctcgaagccttccttctccatctgcggtacctcgtggttgaccagacagccgatggttgcatcgacgttgccggtggtcatcgagctcatcaggtcgaagccaacgtcaaccatgttcacgctgttcggatcggcaccgttggactgcatgatgctgcggaccagtgcctcggaaagctcggtgcccgcgtagccgatcgttttgccctcgagatcctgcggcttggtgatgttcttgtccttgagcgacaggataatgttcagcggaccctgaaccactgcaccgatggacttgatcggcacatcctgctcagcacgagcctgaatgacatcctgctgataatacagaccaatgtctgccttgccggcggcaaccatgctcatggcatcgtttacacctgccggagactggatatccacatccagaccttcctctgcgaagtaacccttctcctgcgcttcgtacagaaatgcgtgcagagcattcggataccagtcgagcacaacggtcaggtgctgcaggtcatcgctgccgctgtttgccgcatcagactgtgcggcgttctgtgcgccgcagccggtcagcagcatggtgcctgctgccagaagtgcaagaatacgctttttcatatatgattttctccttatgttagaacaaaaatttcgttttttcttaaaattgtgttatcaagcttataagctgctgcgccaggtgataattttcttttccaaccagcttacaatacctactgcgatcatcgcaaccacgctcagcagtacgatcggtgcaaacacgccagcgccgtccagctgcgtcatcatgcggcggctgaaatagccgagaccggcctgtgcgcccagccactcgccgatcgcagctccgatgatcgacatcgggatcgccattttgagcgccgagaaaaagtacggcagcgctgccggaatcttcagcttgaggaaaatttccttcttgcctgcgccgaaggtcttgagcatatcgaccatatcggtcttcgccgagcggaagccgtcaaacacggtcatcgcgatcgggaagaacgtgatgagcacggtgacgagcaccttgctccagatcgtgtagccgaaccagagcacaaacagcggcgcaagtgcggttgtcggaatggtctgtgaagcgacgatgagcgggtacagcattttctccgccgacggactcgcgtccattacgatggcgagcagcagaccgagcgcgatcgagatcgcaaggccgactccggtacacagcatggtggccggcagatgtgcggtgaacagcggtttgcgcagctcccacaggcgcacaagcacctgtgtcggcgacggcagaatgtaggccgcattcatgcccatggctatgcactgccagacgatgagcagcgcgaacataaagatcagtgcgggcagatttgcattctttttcatgcctgcacctcttttctgagcagagaaatcagattttctctcaactcaagcatcttcgggtcggtcaggcacgcacgcgtgcgcggatacggtgcaggcacctcaaacgagtgcagcttgcggattggtgtatcctccacgaccagaacacggccggacaggaaaatagcctcctctacatcgtgagtgatgaacaggacggtcttgctgtcctgctcccattggtcgagcaaccactcctgcatagtgatgcgcgtgagaaagtcgagcgcggaaaaaggttcatcgagcagcagcagttccgagccggtcagcagcgtacgcgcgaatgccgcacgctgacgcatgccgccggaaagctcctccgggcgcttgtcgccccagccagccaaaccgacgtgctcgagcgtttccgctgcacgcttgtccatctccgcgcgggaaatgccgccgcgaatctccatcggcagacgcaggttttcgttcaccgtgcgccacggaaacagcaggtcgcgctgcggcatgtagccgcagtagccgcgccgtccgtcaatgctcttgccgtctaccagaatctcgccgctcttgcgcggcagaagctggttggtcaggcggaaaatcgtggatttgccgcagccggatggcccgatgaccgacacaaattctcccttctcaagatggaaggacagaccgtcaatgatgttaaaatcctcactgtcgtactgaaaaacgacgttgcgaaactccagcatggcttacatcgcctcgttccaggccatgtcccagaacatactctcgtagcgcgagcacgcgacgaaaatattggtcagacgcgcaagctgcgactcggtatagccctcactcagacgctccatataagcgaccagcttgcggttttctgccgcatagtcctcggatgcgtagccctgcacccattcaccgtagaactcatgctgatcggcgttcgggtagttggtgacgatccacttggcaatgtattcatagctgagtgcacacgaaagcacagccgccataatctccgccgggccttcctcggctgcaacagcgcgcatgtaggatgtgtaagactcgttattcagcgacggcttgacgcgctcagcctccgcctccgtgatgccgagacggctcatgtagccgcggtgaatgttcatctcaccgccgagaatgttcgccaccgaggttgcgaatacacgcatgatctcgggatcgcgggacttgacaacgccctgtgcgaatacctttgcgtaatcaaacaggtaaacataatcctgcagaagataaaaacgaaatttttggatgtcgaggctgccgtcggcaataccgtggacaaacggatggttcagatagccttcccagatgtcctgcgttgcggcaagcagtctttcggtggttttgttgttcaaggtggtacccccaatgaaagtatgttgatgtttttcctaagactgacggcaaaattctgccggcagcatttttctgcttacagaatctgcaaacagaggttcggcgtcagctcgtccgcgttcagcagacttactgcgtcgatcaggcgcgtacgaaaggaagcggtgccctccatctctttacgcacacgcgcctcggctgtttctccgcaatgcttcatcacctccgatgccgtgactgcggcttctaacaatatatctggattcgcaccgcagtacacgccggtcagtgaggtgagcatacagcctgcgccggtgatccgccgcagatacgcactgccgccgcgtaccactgcggtacgggttccatcggtaattacatccatcgcgccggtgagcatgacgacagctccggtccggcggctgaatgaccgcagccacgctgcggattcctgtaaattgtcctcggtcacgctgtcgagcgcactggcttccacgccggtctcctgctcggctcctgcggcgagcgcccgtacctcggatgcattgccgcgaatgaccgaaacaagattttcactcaacaggtgggaacacatttcacgccggagcgtgctggcaccggcggctaccggatcgagcacgaccggacggccgttgcgctttgcaatcttggctgcacgcagcatggcctcctgtgcacggacagcgcccatgttgattacaagtgcctgtgcgtgcgaggtaatctcctcgacctcacgctcatcctgcgccataatggccgtgccgcctgccgcaaggatgatattcgcgcagtcgttgatggtaacattattggtgatggaatgcaccatcggtgtgcggttctgcgtgttttcgagaacggctttaatagtgtcgatcaatgcttagcaccttccagtgcgctgagaacatgcgtgcgcttgagggcgctcagcaccagaacagaaatcgccgcacctaccgcagtggacacgaggaaggacggcacaaaggtgaacagagccgccttggtattgcccatcacgaatgcggcaatcgggtaggaagccagaccgccgagaatgccggtgccgaatacctcaccaacgtaagcgaccggcagcttcgggcaggccttgtaggccagaccgcacagcagcgcaccgatcatcgagccggggaacgccagcagacttcctaagccgagcacattgcgaatcagtgctgctgcaaagcccatgccgagcgcgtaccacgggcccagcagaacggcgccgagcacatttaccatatgctgcaccggcgagcacttcgcgccaagcaccggtatggaaaacaggctgccaacgactgcaactgcgacgagaacgcctgcaatggtcagtttacggatagaattctttttcattgtctttcactcctccgaaaaaatacggcaaaaatggttaagcggaccgcagccatgccccagaccgggtgcatgacggatagcgtcggtgacgtactctttagacagctttaccgcctcgggcacgctgtggccaagcgccagattggatgcgatcgcagaggacagcgtgcagcccgtgccgtgcgtgctggtggtgttgatctgctcaatctcaatgcggtgacaggtctcgccgtcaaacagtacatccaccgcacctgcgatgttcttgccgcccttgacgagcacgttcctgcagcccttggcatagatgcggcgtgccgcctcctccatgtcctcgggcgtgcggatttccatatctgccagatactgtgcctccggtacgttcggagtcagcacctcagcaaacggcagcacggtctggatgagcgcaccgaccgaggccgggtccatcagcggatcaccgtttttggcgaacatcaccggatcaatcacgatgtgcgccggcttgtactgtgccagcttgccggctaccgccttcatgcactccggcgaggacagcatgccgattttaaccgcatccggcacgatgtcttcaaacaccgcgtcaatctgctcctcgatcatccggggactgatgtcctgaatgtcgatcacgcgtgcagtgttttccgctacgactgatacgataacgctcatgccgaacacgccgtgtgccgccatggttttcagatcggcctgtacacctgcaccgccggagcagtccgaaccggcaatggtaagcactgttttcattcctgttccctccaattttatcatcgctgccgggaaaataaaaaacgcctcgttttcaccctgcggcaaaaccgaagcactcaatcccagcaatgcgacagcttccctacaatggcattaaccaacaggttcaaaaggttgggtttctcgccctctcagccgctcatcacagcacccttgcttgtcttttacataatatcagtataagccgtgtaaaatgcatttgtcaagtatagaatcttgctgtatctgatacgccgttaaaaaataaacaaatttttatttatcaatactgccggatttgcaggtgttgccaaaattgcattttgcgtctcctgcccggttgacaaacagcaaaaagaggtctattatacgaatcgttcagtagccaaatgctttgaacaggacatgacgtatccgtatcaccgctcacagaaagccgtcggtcgtgcaagacggcagcaaggcacgggttcgctatcccctgcgagcagcttcgatcaaaggcaatgccgagtagtcgaggccggatatccaccgttaacaggaaaagccctccggaagaatgcggtaccgggcggcaatgagaggtcggcagcgtactgtcggcaagcaaagtggtaacgcggaagtaaatacagcaatagcaatgtatatgccttcgtctttgcaggatcatcttcgtgatcctcctgcatggacgaaggcttttttgcgtacctttggctgcggaatcgcaaatcatttcaagaaagagacgaaaaaacatgaacacacttgtaattgtgctgatcgcggctgttgttctgttcggcgcgtacgttttctacggacgctggctggcgaacaaatggggtatcgacccgaaagccaagacgcctgccgttgaatttaatgacggcaaggactttgtgccgaccaacggctggacggtattcagtcaccagttctcctctatcgcgggcgcaggccctgtaaccggcgcaattcaggctgcggcgttcggctggctgccggtactgctgtgggtactgatcggcggcgtattcttcggcgcggtagccgacttcggcgcgctgtacgcttcggttaagaacaagggcaagtcgatgggtatgctgattgagaagtacatcggcaaaaccggccgcaagctgttcctgattttctcgtggatcttctgctgcatcgttgttgcagcattcgcagatatggttgcgggcacattcaacgcctacactgtcactgacgcaggcgttaccgagctggctgctaccgcaaccaccaacggtgcggcaggcatgatctccatcatgtttatggtattcgcggttgtgctcggccttatccagaaaaagtttaacctgaccggctggaaggaagccgttgtcggcattgtgtgcatcgttgcctcctttgcaatcggcatgaactgcccgcttatcttcggcaaggcagcatggagctatatcaccttcgtctatatcttcttcgccgctgtccttccgatgtggctgctcaagcagccgcgcgactacatgaccaccttcatgttcatctgcatgatcgcaggcgcagtcgtcggtctggttgttgcacatccgactatgaacctgccggtattcaccggttttaccaatgagaagctcggcacgatgttcccgatcctgtttgtaaccgttgcatgcggtgcggtttccggtttccacagtctggtttcttcgggtacgtcctccaagactatcgagaacgaaaaggacatgcccaaggttggctatggcgcaatggtgctggaaagcctgctggctgttctggcactgtgcgttgccggtgctgctgcagcagctgacggtacgccggcagcgggcacgccgttccaggtattcagcagcggtgtcgcgggcttcttcgagatgttcggcgttccggtttatgttgctactgcatttatgaccatgtgtgtttccgcactggcgctgaccagtctggacgcggttgcgcgtatcggccgcatgagctttcaggagctgttctccgtcgatgacatggagcatgctgagggctggcgcaagctgttctgcaacgtatatttctccacggttatcacgctggcatttggtttcctgctcaccaagatcggctatgccaatatctggccgttgttcggttcggccaaccagctgctgagcgctctggtgctcatcacgctctgcgtattcctcaaggttaccggccgcagcaacaagatgatcttcccgccgctgatcatcatgctgtgtgttaccttcaccgcgctggtgcagcgtttccttgctatggtaaaggcaatctctgctgccgcctcaacggctattccggccggtgagaccacttggggagcggtattcatcgcaaacggtctgcagcttatccttgcggtactgctgattgtgctcggtctgacgatcgttatccactcgttcaagagctatgccaagagcgagagaaacagcgagaacgcgtaaagcgattctcgatataacaaaaacggcttcgaaaaaccgaagccgcaagactatcgaaaaacccggttgcagcctaatcgcaaccgggtttcttgataggaaaaattcacggagtaattacagattactcattcctgattattcttaaggcaacaccgcacaattaaagctgttcgcggatcagtgcacccatctcggaggtggacagtaccttctcaccctttgcggcgatgtccgcggtgcggtgacctgcgttgaggacattctcaacagcggtttcgatggcgtctgcctcggccttgaggccgaacgagtagcgcagcatcatcgcgcacgacaggatggtcgcgatcgggttcgcgatgcccttacccgcgatgtccggcgcggagccgtggataggctcatacatacccttgccgctctcgttcatggaggcggacggcagcataccgatagagccggtgatcatggaagcctcatcggacagaatatcaccgaacaggttgccggttacgataacatcgaactgacccggattgcggacgagctgcatcgcgcagttgtcaacatacatatcggtgtactcgacctccgggtactcatccttgatgcggtgcatggtttcgcgccatacgcggctggtttcgagcacatttgccttgtctaccgagcagaccttcttattgcgcttcatcgccatctcaaaagcacggcggccgatgcgctctacctcataaaccgagtagttcatgtcgtccgcgccggtctcgccccagcccttgtcgctctcgcggcgatagtgcttgccgaagtaaacatcgccggtcagctcacggcaaacgagaatgtcgaagccgtcaccgatgatctcgggcttgatcgggcacgcatccgcgagtgccttgtgcatctgcgccgggcgcaggttgacgaacagacccagtgcagcgcgcagaccgagcagcgccttctccggacgctttgcactcggcacatcgtcccacttcgggccgccgactgcaccgagcagaacggaatccgcgttcttgcagatctcgatggtctcatcggtcagcgggatgccgttcttgtcgatcgagcagccgcctgcgaggacttcctgaaaatgaaacttgtggccgaacttttcgccgaccttatcgagcacgagcatagcctcggatacgatctccgggccgatgccgtcacccttgacaacagcaatattgtattccatgggattatgcctctctctccttgagcgacttgagcaggccgcctgccttgatgatgttctggataaacggcgggaatgcagctgcctgccagctctcgcccttggtaacgtcggtgatcacgccggtgtcgaagttgacctctacctcgtcgcctgcatcaatgccgttcgccgctgcctcgcactcgaggatgggcaggccgatgttgatggcgttacggtagaagatacgcgcgaacgaggatgcgataacgcaggaaacgccgttctcacggagaacgagcggtgcgtgctcacgggaggagccgcagccgaagttgcgggttgcgacaacaatgtcgcccgggtgcatattcttgacgaaatccgcgtcgatgtcctccattgcgtgggtggacagctccttcgggtctgcgatattcagataacgtgcggggatgataacatcggtatcgacattatcgccgtacttgaaaaccttgccttttgcgttcatggtatgtgtttcctcccttacttcaggtcgtccggtgcgcagatatagcctgctaccgcacttgcggcagcgacggccgggcttgccagataaatttccgaggtgatatgacccatacggcctacaaagttgcggttggtggtggaaaccgccttctcgccgtgcgccaggatacccatatgaccgccgaggcacgggccgcaggtcggcgtggaaacgatagcgccagcctgaatgaaaatcttggttagaccctcctcgatgcactggaggtaaacttcctgcgttgccggaatgatgatggtgcgcacattcggatttaccttgcggcccttgaggatttcagctgcaacgcgcatatcgtcgatgcggccgttggtgcaggaaccgatgaccgactgctgaacctcaatatggccgaggtcgtcaatggtcttggtgttctccggcaggtgcgggcacgcgatggtcggacggagtgcagacaagtcgatctcgatggtctgctcgtactcggcgtcagcgtcggcctcgaatgcggtaacctcgcggtttacgcggcccttgatgtaattcatcgtcttgtcgtctaccgggaagatgccgttcttcgcaccagcctcgatggccatgttgcagatggtgaagcggtcatccatggacagcgcgtgtgcaccctcgccaacgaactccatcgacttgtacagcgcgccgtccacgccgatcttgccgatgatgtgcaggataacgtccttgccggatacccacgggctcagcttgccggtgagcacaaacttgatggcgctcggcaccttgaaccatgccttgccggtcgccatgcctgcggcgaggtcggtcgagccaacgccggtggagaatgcgcccagtgcgccgtaggtgcaggtgtggctgtccgcgccgatgatgagctcaccgggagcggtcagacctttttccggcagcagcgcgtgctcgatacccattgcgccaacgtcgaagaagtttacgatgttgtacttcttggagaactcgcggcactcaaggcactgctctgcggacttaatatccttgttcggtgcaaagtggtccattaccagcgcgatcttagtgttgtcgaacaccttatcgaagcccgccttctccatctctcggatggcaaccggaccggtgatatcgtttgccagcgtgagatctacgtttgcctcgatcagctgacctgccgttacgctttccagacccgcatgctttgcgaggatcttctgcgtcattgtcatacccataacagcgttcctcctgctgaattagtcgttaaaatacttgttaatgccgttgatgtacgccttgatggacgcctccataacgtcaaccgatacgccgcggccggtaacaacctcgttgctgccgtctacgcggatcttgacaatagcctcgctctgtgcgtcctcgccgtcggtcagtgcgcgcagcgagtagtcctccagaacgatttccttgccgatgatcttgtcgattgcatggaacgatgcgttgatcgggccgtcggaagcggcagcgcgctcaaacatctcgtcgcccttcttgacgcggataacagcggtagaggtaatagtgttgccagagttgatgacaaagcggtcgagcgtgtagcgctcctcgccggaaaccggaacagcaccgatcagaccctcgaggtcgcggtccttgatgaccttcttcttgtcagccagaatcttgaacttctcgaatgccttttcgagcttctcgtgatcgagcgtgtagcccagctcatgcaggcgctcctcgaacgcatggcggccggaatgcttgccgagcacgatggcgttcttcgggatgccgacggattccggagtcatgatctcgtaggtttccttgttggccatcacgccgtgctggtggatgcccgcctcgtgtgcgaacgcatttgcaccgacgatcggcttggtcggtgcaacagcaacgccggtaatggtctggatcatgcggcttgcgcggtagatctgggtggtctcgatgttgcagccgatgccgaagtggtcggcacgggtcttgagcgccataacgcactcctccatcgaggcgttgcctgcgcgctcgccgatgccgttgatggtgcactcgatctggtcaataccggcttcaacgcctgccagagagtttgcaactgccatgccgaggtcgttgtgcatgtggcaggacaggattacgttctcgataccctcggtgtgctcacgcagatacttgatgcgggatgcgtactcctgcggaatcatgtagccgacggtatccggaatgttgatggtagtagcaccggccttgatggcggtttcaacgacgcggcacaggaagtcgagatcggaacgggttgcgtcctcagcggagaactcgatgtccgaacagaacttcttggcgaaggctacgttgtgcgctacggattcgagcacctcatccggtgtcatcttcagcttgtactccatgtgtaccgggctggttgccaggaaggtgtgaatgcgggcagactctgcacggcggatggaattccatgccgcctcgatgtcctgctcacggcagcgtgccagcgagcagatggtagcgccgcgcacggtatcagcgattgctgcgatagcagcagcatcaccgggcgaagcagccgcaaagcctgcttcaatgatatctaccttgagggcttcgagctgctttgcaacctcgatcttctcattcaggttcatgctgcagccgggagactgctcaccgtcacgcagcgtcgtatcaaaaatcttaactgttcttcccatggtatcttgtcctctcctattcagaattttaccgggcttacagggacaaaaaaagctccgtcccttaatccaatcattaagagacgaagcgaaagctccgcggtaccactcttgttgccgcagtatggtgcgacccctctatgcacatctgacaatgcgctccccctgtaacggtgggtatccgttccctcctaccggtccgaaggactttcagcggacagctcccgggcgagtttcactgcttcctgacgctgccttacaccaaccggcagctctctgcggacaggggtgacaattactttacccgttcatcacctttatcaatatgtttttatattagacctctgagccgctgttgtcaagactttttttaaggcagcgccgggcatactgcaccgcaaacagatttgacaaaccttctccaatatagtaaaataacactgtgtacaggaaaacgctgttttcctgagcacatctgttaaaagctgtgaagagaagagtacgcagtgaagtacgtcaaagcgagttccgggcggtgaaagcggaacgcggagggcactgccgaacatggtcttggagcttcgcaccgaacttactttgtaatagtatgcaaggctgcggcggcaaagtcctgccgttatcgaggacgatgggtagcatcctacccgctgaggcgcctttccgcgaggaaggcgtaaagcaaggtggtaacacggaaggtttgtcctccgtccttgcagtggcaaaatacaggccattgcaggaacggaggattttttgttccctgttccctgctgtcacgcataaaacatatttatatatgtaaggagagaatacacgaatggacaagaaaccctattatatctcaacggcaatcgcctatacctcggcgaagccgcacatcggcaacacctacgagatcgtgctggccgacgctatcgcacgctacaagcgcatgaccggttacgacgtttacttccagaccggcacggacgagcatggtcagaagattcaggagaaggccgaggcagccggcatcacgccgcagcagcacgttgacaagattgccggtgaggttaagaccatctgggatctgatgaacaccacctatgacaagttcatccgcaccaccgacccgatgcacgagaaaaaggtgcagaagatcttcaaaaagctgtatgatcagggcgatatttacaagggcgcgtacaagggtaaatactgcaagccgtgtgagtccttctggaccgagagccagctgaaggacggctgctgcccggactgcggccgcccgtgcgtagacgccgaggaggaggcatacttcttccgcatgagcaagtacgccgaccgcctgatgaagcacatcgaggagcaccccgagttcatccagccggagagccgcaagaacgagatggtaaacaacttcctcaagccgggcctgcaggacctgtgcgtttcccgcacctcgttcagctggggcattccggtagactttgacccgggccatgttgtttatgtttggctggatgcgcttaccaactatatcaccttctgcggctacgatccggacggcaaccacgatgagcactacaagaagttctggccggctgatgtgcacctgatcggcaaggatatcatccgcttccacaccatctactggccgatcttcctgatggctctgggcgagccgctgccgaagcaggtattcggtcatccgtggctgctggtcggcgacggcaagatgtccaagtcgctcggcaacgttatctacgcggacgatctggttcgcctgtttggtgtggatgccgttcgctactacgttctgcacgagatgccgttcgcaaatgacggtgtgctctcctacgagctgatctgcgagcgcattaactctgatctggcaaatgtgctcggcaatctggtcaaccgcacgattgccatgaccaagaagtatttcggcggcattgttccggcgccgaccgcaccggaagcacttgatgacgagctgaaggcagtcgcactcggtctgccggcagctgttgagaaaaagatggacaccctgcacgttgcagacgccatcgacgaggtattcgcactgctgcgccgctccaacaagtatatcgacgagaccatgccgtgggcgctcgccaaggacgagagcaagcaggcgcgtctgggcacggtgctgtacaacctgctcgaagcgatccgctttgccgctgttgagctgaagccgtatctgccggacaccgccgacaagattttcgcacagctgggtgttgaaaacaagggcgttgagagcctgacctcgtttgatggtatgcagccgggtcagccggtcggcgaagcctccatcctgtttgagcgtatcgacattccgaagaagctcgctgagattgaggaggaaaagaaggctgccgaggcagagcagaagcctgcagttgagttcctgccggatatcccgtttgacgatttctgcaaggtcgatatgacggtctgcaaggtgctcgcatgcgagaacgtcaagaagagcaataagctgctcaagttccagctggatgacggctcgggcacgccgcgtcagattctgtccggtattgccaagtattacaagccggaggagctggtcggcaagacggtcgttgccgttaccaacctgccgccgcgcaagatgatgggtcaggagtccaacggcatgctgctttccgccgaaaaggacgaaaagctcaacctgctcatgctggacgacagcattccggctggcgccaagctgtgctaaaataaacacactttacaacgaattcagcagggcggggtgccctcaccccgccgcacataaacgggaacactcggttgcaacggcgggctgagggcagcccgccctacgaatgggttaacagatgtgttatcccatgtataatttcgcacacactacaatcaacaatttaggaagcgaaaattatgacaagagggcgaaatgcaatgtggatcatttatgcgctgctctctgcggtatttgccgcactgacaacgattttagccaaaatcggcgtggaaaacgtggacagcacgcttgctactgctatccgaaccgctgtggtgctcgtgatggcatggggcatggtcttcctgctgggaaaacagggcggcgtaagcgcaatcggcgccaaaagctgggtattccttaccctgtccggactggcgaccggcggttcgtggctgttttactacaaggccctgcagatgggcgaggccagccgtgtggctccgatcgacaagctgagcgttgttatcacgatgattctggcgtttgttgtcctgcacgagaccgtgacggtcaagggcgtgatcggcggcattctgattgcggcaggcacgctgtttatgattctgtgatatattttaagcaaaagagttaagaacagagtggagagtggagatttatgttctctgcactctccactcttcactctgttattgagggttttacatgcacaaaaaatacttcttttttgatattgacggcacactttcgaccggtctgaccaccaccatgccggaaagcgcggtaaaggcgcttgctctgctgcgggagaacggccatttcaccgccatcgcgaccggacggttgcaggcttctgcggcgaccgtggccgcgcgctacggcttcacggacattgtagcggacggcggctggagcgtaacgcacaacggcgaaattgtcgagatggagtcgctgccggcggccgactgcattgcgctgatcgagcggctcgagcaggccggtattccgtgggcggtgtcgccggagaacgagaaactatgcgtaacaacggataaaaattatcttccgtatgcaccggagaactacttccctgttctgtgggacccgcattttgattatcacaggctggagcatctgtacaaggtttactacgtctgcacgcctgatgaggagaatcatattgacgcgggcggtctgccgcttgtgcggtacaatccccatgtgattttcgttgagccgaaggaaaaacagcgaggtattcgctattttcagcagcttttatccattccggatgaggatattgtggtgtttggcgacggcatgaacgacatctgcatgttcggtcagggatggctgtctattgcgatgggcaatgcccgcgccgcgctcaaggagaaagcggattacatcacaaccgacgtggataaggacggactttggaacgcctgcaggcatttcggctggatttgaggaaggtttactatgctttttgatacacatgcacactatgacgatgaacggttcgacgaggaccgcgatacgctgctggcttccatgcccgagaacaatgtcggcctgattctcaatcccggctgtgatgtggaaagctcgcgcaaagcggtcagctacgcgaataaatatccatttgtatatgcggcggtcggtattcacccggagaacatcgaggacggctgggaggctgatctggagaccatccgcgcactggcacagaacgaaagcaaggttcgcgccatcggcgaaattggtcttgactattactgggaaaaagacgagcgtgcgcgtgcgcggcagcaggttgtatttgcccgccaaatggagctggcgcgtgcactgcacctccctgtcatcgtgcatgaccgcgatgcgcacgccgacagcatggagatcacccgtcggtatccggatgtgatcggcgtgtaccactgctatgccggtcacgtcgaaatggcacgcgaactgctgaaactcggctattatctgtcgtttaccggtgttatcacattcaaaaatgccaaaaaggcgaaggaagtcattcgtgaagtgccgattgagcgactgatgatcgagaccgattcgccctacatggcacccgagccgtttcgcggccgccgtaattcctcgctgtatgtgcatcgcatggctgagactatcgcggaaatcaagggcataagtgccgcagaggttgaacggattacaaccgaaaacggcagacagctgtttggtatttccgggtaagatagagcaaaacagggacaagaggtaaaatctcttgtccctgttttgtatggtggagacggtggggatcgaacccatgacctcttgactgccagtcaaacgctctcccagctgagctacgcccccgattcggctaataaactttgcataaaaattataacgcaacggattggttaatgtcaagcacagagtatttagcagtatcaccgaaatcgcaaagcaaaaattggtagtgctgccgaaaatttaggcggaactgccaagttttatcctctcctgttagctttgcaaaccgctttctgttatactgtttgcataaggaagtgacagccatgtatttcgcgtacggacagaccgaaaccgactatctcaaggccaaagacagcagacttgccgctgtcatcgaccggctcggccatattaaccgaacagtggacaccgacctgttttcctcggtcgtgcaccatatcatcgggcagcagatttccacaaaagcacaggcgaccatctggcagcgcatgcaggacgcgctcggcacggtaaccgccgacagcatcgccgcagccggtgttcccctgctgcagtcgctcggcatgaccttccgcaaggcggaatacatcacggattttgccgaaaagatacgcagcggcgctttcaatctggaaagcgtgaagtacatgagcgacgcggatgcaatccgcgcactcagttcgcttaagggtatcggcgtatggactgccgagatgatcctgctgttctgcctgcagcggccgaacgtgttcagctacgatgatctggcgatccagcgcggactgcgcatggtatatcaccaccgcaaaatcgaccgcaaactatttgagaaatatcgtcggcgattcagtccgtactgcagcgtggccagtctgtatctatgggaagtctccggcggtgcgataccggatatgcgcgattatgcgcttgtaaacaaataaaaatccgttccggctgcttcttcacggaacggattcatcagaaaatggagtgttgacagacacctgtttttccgttgtctgcacatatatagtagcgatattttccgcgtttgtcaaccttttcagcgttttttgtgcaacgttttaacccgattcgtcaaaattcgcaattcatcgaccgaatcagcaaattttcggttaaaaataccgtatagagaaagtcccggacagccttccgctgcccgagacttggggtggttttattttgattgcatagttgatagtttcatgcgagaatggctggtgcgtcagcaggaataccgggcaggagaaatcacacgagaagaatactttgagtggaagctgaactggccggatacctgcgacgatttgggcaaggtcacaccgactattaagtggcgcaaaaataaataaagacaagcaaaaaccgccctgctgaattttgtcgttcagcagggcggttttacttgtcctttgcaattattctcagcgatactgttcagactaacttagtatcaaatcagtatcagcaggcaaagcgacaggcaaaagaacctgtatttatgcggatttcggaggtttccgaaattattcccactcaatcgtagccggcggcttactggtaatatcatacacaatacggtttacgccgacaacctcatttacgatacggctggaagccttatcaagcacctcatacggaatgcgcgcccagtcagcggtcatgaagtcgctggtggttacgccgcgcagcgcgagtgcgtaatcataggtgcggctgtcgcccataacacctacggtgcgggtgttggtcagaactgcaaaatactggttgatctccttgtccagacctgcatttgcgatctcctcgcggaagattgcgtctgcctcacgcagaatgtcgcacttctccttggtgatctcgccggtgatgcggatgccgaggcccgggcccgggaacggctggcgcatgacgagttgctcggacagaccaagctcaaagccgagctgacgaacctcgtccttgaacagcatgcgcagcggctcgatgatctccttgaagtccacaaaatccggcagaccgcctacgttgtggtggctcttgatgacagcggcatcgtccttgccggactcgatcacgtccggataaatggtgccctgtgccagatagtcgatcttgccgatctgctcaccaatctgcttgcccatcttctcaaacgtacggatgaactgtgcaccgatggccttgcgcttgtcctccggatcggtcagacccttgagagcgccgaggaatgcgtcctcctcgttcatgcggatcaggttgatgtcccacttggagaaagctgcctcaacctcatcaccctcgttcttgcgcatcagaccgtggtctacgaatacgcaggtcagctgattgcctactgcctcagccagcagggcagctgcaaccgaggagtcaacgccgccggacagcgccagcagaaccttgccgtcgccgaccttctcgcggatggccttgatggagctgttcttgtaatcgcccatggtccagtcgccctttgcatggcagacctcgtacaggaagttcttcagcatgagcgaaccgttctcggtgtggtttacctccggatgatactgtacgccgtagaagccgcgcttctcgtcagcgatggcagcggtcggacacatatcggtgtgagcgaccagctcgaagccctccggcacctttgccatgtagtcgccgtggctcatccaggaaataccctgctccggcagacccttgaacagcttgcagtccgtgttgtagaaggtctcggtcttgccgtactcgcgcgcagtgtcctcctgtgctgcggttacctcgccgccgagggtgtgcgccataagctgacagccgtagcagatgcccagaaccggtacgcccagctcgaacagagccggatcacacttcggggacttttcctcgtaaacgctgttcggaccgccggtaaagatgatgccgatcggattgagcgccttgatctcctcaatcgaggtcttatagggcttgacctcacagtaaacattatgttcgcggacgcgtcgtgcaatcagctgattgtactgaccgccgaagtcgagcaccagaacaagctgatgattttccatcgccaatctcctttctgttttcccaatgtatatataatagaattatgccacatttctgcgttttcggcaagggcttttgcggaattttccgtttcccgacaggaagaaaacatacacgaaccggaattctgccgatccggtataaaatttaacagccgcgtgcatactttccgatagaagaaacgaccggaaagggtgaaggattttgaaaaacaggcaaattcgcatcattgcggtgctgctcgcaaccgtgctcgcctatgcgggactgatcggcgctgccgccgtaaccgcgcaggcggcggacaatgcaccggtggtgcagccggtcacggcgcagacctgcgtggatattgctgtggaggctgaactgtccgcggccgacgcagataacgacgtagtgctctatcagcttaccgaaaagccgcggctgggcacagcgaagatcgagggcagtaccttatattacacaccgggccgcaaagccggacgcgaccgcttccactataccgccgtggatgccgagggaaatacagcgcagcctgccgctatcacgattgagattaaaaagaataagaccggactcacctactcggacatggacggtgatccggcgcattacgcggcgatctatctagcgcaaaagggtgtaatgaccggagaaaccatcggcagctgtgcgtttttccatcccagccgaccggtaacacgcagtgagttcatcgccatgacagccgccgcggcagatctgtccgttgaaccgacagaccagaccgactttgcggatgacagcggactttccgcgtgggccaagccgtatatcagcgccgcagccgcaaacggactggtcagcggctacgcgaccgtctccggcgtgagtgagattcgcggcgagaaaaccatcacaacggccgaggcaggcgtggtgctcgaccacctgcttgacggcacgctgagcggtgtgcagtacgcttggtcgatgtccgaccattctccgcaggattgggcacagccggcaatcgctcggctggaacgcgcctccgtactcaccgctgcacaggcacagaacccagaacacccgctcgaccgccgaacggcgtgcgaaatgctgtaccgcgcactgattttgctggattcttgacgaaaatcagcagcagtgttacaatagtgcagggagaagcttggacttctccctgcttttttctgattttgaaaggactgtattcgtttgcagcaaattgatttttctcagggcagcatccgccgcaggatacttgcggtggccacaccgatgctcatcgcgcagttgctcaacctgctgtataatattgtagaccgcatttatatcggcaaaatccccggcgagggcacgcttgcgctggcaagtatcggcttgtgctttccctttgtgacgctcattaccgcgtttgccaatctgttcggactgggcggtgctccgctgtgcgcgatggcgcgcggcaaaggcaaccaggaaggcgcacaaggcatcatggtcaacgccggctttatgctgctgctgagcggtgccgtgctgaccgtgctcggcatcgcgtttcatcgcccgctgctctacctgttcggcgccagtgaggtgacgtacccgtatgcgtcctcgtacatcgtgatttacttgatcggtacgctgtgcgtcatgctgtcgctcggtctcaatccgtacatcaactgtcagggctttgcccgaaccggcatgctcaccgtggcactcggcgcggcagccaacatcgtgctcgacccgatttttatcttcgcactgcacctcggcgtgcgcggcgctgctatcgcgaccgtgctgtcgcagcttctgtctgctgcatgggttgtcaagtttttaaccagcaaaaaagccgagctaaagctggatttccgcggtttccggccggactggcagtgtatccagcgcattaccgtgctcggcatcgccagctttgtcatgtcgtttacggatacgctcgtgcaggtggcgtgcaatgctactctacgcaatttcggcggcgacctttacatcagcgtcatgactgtacttaactccgtccgccagatcgcacaaacgccggtgctcgccatcgcggacggtgcatctaccgccatcagctacaactatggcgcgaggctgtacaggcgcacccgggacgccatccggtttatgacacagattgctatcggatataccatgcttgtctggatattggtttctcttttccctgccctgttcatccgcattttcaatcaggacgcggagctggtcgcggcggctgttccggcgctgcacatttactttttcggctttgtaatgatggcgttccagtattccggtcagagcacgttccgtgcactgggccgggcgaaatacgcggtgttcttttcgcttttgcgcaaggcgttcattgttgtgcccctgactttgctgctgccgtactgctggaatctcggtgtgagcggcgtatttgcggcagagccggtgtccaactgcatcggcggtctggcgtgctactttaccatgcggcatgtggtgatgccggagcttaaaatggagaattgaagatagaggatggagcatgaacttcaaattgaatctcatgctcattccatttaccgtccctcggacggcattcaattatctcccttcgtgcgacaccataattctcaattttccattccgactcgctaagcgccgcctgcggcggttgctcgctggacgcccactgcggtgggtgtctccattctcaattattatataagtacactcgaaaaaggagtcggacaaatccggctcccttttctgcattgcgaggggaaatcagcagcactttcgctggaaggacttacagtcggtagagtagtagattctgcgcaaaagtctacaagatactcctctcgtgattattcgattgtcggtaagaatttgtacttaatttttacagtttggccatagtttccgccatcaaaggtgcggtgacgtctgccttcaggaagagtgtaatgagatacttctatacgttcgataaacgcctctaatgcatccctcgttaattcttgaatcggttcgtcatatggcaagtcgttcaaaaaattatcaaaggcatcgtcacccagctcttcacacatattttctcgcaatgatgcgattcgtttttcgcgggactcaatttctttattatatttctctaacaacgattcaaaagtttttttgtttatcagcccagatatattattctcgattaacgtcgagatagcttgagtcgttttcgaattctgctgttccaaatcggcaatttgcttttcaatatctgcattagggcttgtggcattgaacctcttcttgataatatctgccagagattttctttcttcaaaactcatcgacagataataattcaaccgtgtttttacgatatcacacaggtcatcataacgaatggagtggctcaagcaggctttatttccgtaccggcaatttgttccacaacgcaaccctctaacaggctgattgttatgctcggttgtatttctcgccatacccatgcgagctccgcatgtgtcacaaaaaacaaacccagaaaagatgttcttaaagaacccatcagcccttgattggttttttgtcttttgacaacggtcgaataattcttgtgagactaaaggctcgtgggtgtttaaggttttatgccattcttccctcttttttcgtttgcttttctttttcttgaaattcactctttttgtcttgcctaaaacagtgtgccctaaataaacctcgttacgcaacataacgtatattgtagaacgagtccatttctgtgcatcttccggcttctcaaaactgacacacctgtccgaccttgtcaggccggggttttcccaattctttaattccaatggagtgggaaccccctcggcatctaacgttctaatgatatctatcattctttcgccagaagcatacattgagaaaatcttcttgaccacccagtcgcaccttgggtcaggaatcaagtgcatattgtcgttggggtctttaatataaccataaggggcgcgggtgcaatactctccgcgatctctcttaactcgaatcgcattggttacttttcgggatgtatctctcgagctcatctcattgaaaaggttcttaaaaggaacaattatatcgtattctttaagcgtgtctactccatcgtctacggcgacatatcttacaccaagctgcgggaaagtttcttcgatgaacttgtctgcttcgatatggtctcgagagagtctcgacaagtccttggttataaacatgttgaactggccgctctccaatgcgttcatcgccagaatgaatccttgtctgtctgtattcaagccagaacagccatcatcaataaactcgtgggctaaaaagatattattcctctggcagtattctcggatgatacttctctgattttcaatgctttcgctttcacctaaacgagcatcttcttttgataatcgtagatatgctatagcaatatattgctgaagcatattcaaagtctcgttcactttttttgcctccttatcaaaaaagaacgaaactatatatacaatttgagtatatcacaatttcgttcttttcacaaactctttattagttcttcatcattaagccgtgatcatcgtcatgatgctgtaattctttgcaataataatctgttgctatatcaataagcgggatgttaccgaaggattcctcgacgagaaatcctttaactgtgaccttatttacctgttcttccggcattttatcatctcctataaacattttctccttttctttggtttgttatactttcgagcatggtgttaattacctattcacacctattgattttatcgaacatttgttctataatgggtttgaggtgatactatgtacgaccccatcagcggcaacgccgcgtatgcaaagtattctccggttactctgccgccaattggacagcgtgcaggttttgccgaagtcagtgtgaagctcaatccgcacacatcacaaccagagctgataacttatctcaacaaaggctatcgtgtacgtcttgtcactggctgcatgttcaataaagaccttcgtgccaccgagtacggggtcaaaatcggcaaccatcggacgaaggtttggaaaacgcccgagggcgtgtggtatatccatcccaataggtgaggcacccgaaagggtgcctttttttacggatacagcgaaccttgacgaattttagaaaatgcggtatgattggtattgcaccaccagaatcacccgcaattcggcgggttttcgcagtcccctaacgactgcgtcgccttctgtaaaaggaggttactatgagagattttcgatctaaagttcgctgttccgctgctacggtagcgtatggagtgctcgcggccgccctttgggacgcgctgaaattcttcattgaacagcttacctgaagtctcttcggtgcttggagcggcaaagccgctccttttttcttcttgaatcgctgttctttgttgtttgcgatctttaaggcagtcgcgagcacgttgttgtaattgttagtgaactggctctttttatttgactattcgctatccactgcggtatgatgccgttggcggcctttggtaattcggatcaatttgatattctcctttttcgaaaggaggaaactcatgtcactgcaactaatagtagttcagttcataatcggcatcgcttcggcgggcgcatggttctggattgagcgaaagttctttggcaacaagtaactggctgccactgagacgtcgagacggtacctcgacgtctctttttaattgccagtggaaccaaggccgccggttctcttcccccgtggctcgtcatcaaccgtgacgccgtaaggaacgaacacgccctgcatgaatcggtcgcccgctcgcaggtgcattgttttgccttcacggctgtcgttcgtgatctttgccataatgtggccttcgttttcggcgaaaatgtagtcaccgtccacgatccctgtgccattatcgagctgcatgcggtacttgaagcccatactggaacgcgggaacagcatcagcacccagccttcttcgatctggcagcgcatgccggtcgggatcagtgccgattcgcccggctcaaggataacgtcatacggcacgcggaagtcatatcctgcactgccttcggtcgcgcgatcagggaaaacgaggtcgcgccacatatcttcgatgcaaccctctgaaatgagcgggttgcatttttttacgtctgccgtgaactgcggaaagctcacggtgtcaaattctgctactgttaaatacaatgtttgtcctccttatgtgtccaatgagcgtttgtcagtttcgcgcttgtcaatagcccaacgcagcgcggacagaccgccagaaagaaaaccatactcccaagtgtcgagtttgtcgtaccactcggtgccgtatttttcttcaacttcttttcgagccttgagcatgccctcgatgatatcttccggcgtgccgccaattctcagatcttctggcttgtgaagctgtgatcgaacataccatactttatcgtgcagctcgctcatatactctttgatttctttactcgttttcatcttttttacgctccatgttgtgttttactcgcatttcaacttcctgctgtttacctttgttgaatgcggtcttgtagtcgtttgtaagatagccggtcactcgacgcaggcgtttgatgtccttactgccgcactgcggacaggtgtcgttgatttcgtcgcaatagccgcagttcatacactggtcgttcggaacattcaccgcaaagtacgggatgtccatatccatcgcgtaattaacgacggtctcgagagctgaaatgttgttcttacaagtagattccagttctacataagtgatacaaccagcggaagaataaccggtcagctgcgactcgatgccgattttgtcgaaaatggagacctttctccacaccggcacatgaatggaattggtgaagaaatccttgtcggatacgttcggaatagttccgtactttgcctgaaatttcttcattgcagtgtaacataagttttctgccatttttatttgggtcatattttcatcgtatttttcatacgagttcgctctttcgcttgcgctactctactttaccttatcggatttcgatgacctccacgcatttatcgttgcttaaaattttatagagcctttagattgatggttgatagaacgtaaaatatgtgccatttttaggcttgcggacaggtttatgtcctaatttacattcgtagtctactaccttcgaatacacgcctgtttgacgtgctgcctcctatacattgaaatatcttcctatttcacaatctgtttcatagtcgtattggataacaatctgaggcggttcaaccgacgggtctgattgaaatcggaagtagaatggtttacgaacaggtttcttataccggcattggcgcaaaactgtatttttagggattcctgtttctcgcactgcttcgctggcacttccataccttcctatctcttcgttggtataagtgttgaacattatgacagggatagattgagaatcatcatagccttttgcatttacggccaatccatcgtcgaacgctttttttgtattctcagagattgtcgtccaatacagattactcaacctaatatctgttttgatgttgtttttgtgtccaacaataggaaatttattaggattcggaagcaatgtttccgcaatcacaatgtgcaacctgcgacgtcgaatttcgtatgtcccatctgatttaatatatttgatgggtgcataaacgtaaccatttctccgattcacggtggtgttatactggaagaactctccataatgtttgtgcggaatttttttatctaattttttgttatataatgttcgtgtttcttgtccataaagattcccagcaggggttacccaacacaaagcgttttttacctgaactgcgtcttctggcagtttttcgatataatttggcatattataacctcctttctataaaaattttaagcaacgaacttagttcggtattccttttcaggttcaccgagttaggcgattttttcagtatgtgttaccacatacgcccccgcaagatgttatatgttacattcaggggtaaaataaacaccgaagttcaaatgatattcttccttgaactcagcgcatctgtctttgaacaactgttcaattcgcttggcgagttccatgccggcggctgtggtgtggtcgcaaccaatcagaatctgcaaggtttcagccagaccaatctgaccgacagcaagcgttccgtgcttcagagcagaacgaatgccttcttccggcacatagcctgccattacgttgttttcgtacatgaacttagctgcttctggagactgagagcaaatccaatcgaagcgctccaaaagcatatccttagcctcatggattttggtgtccagcaagtccataaagctgtcaataatggcctcttcaggggcttttgcatggactaccctttcttttgcttccatcgccaaagtaggcatgatgatagtcaccggacaaatgttaccgcgaccgtcctttaactggccgaatccgttaatgtcccagccatttgccgtcctgcagcccatggtactaaagtacgttttgggatcgttgatatcatagcctgcgtttcctgaccaatctacgttggcgtagttcggatacagtcgctgactggttgatctgagggcgagttggaagaggtcgtaattgggatcgccttccttgcgattcacacccttcatacactgaaagatgccgcacgggaaaatgctggtgcgatgcagtttgccaatgcccttgatggacacatccagaagagccttcgttaccattcgaccttcaggcaacgtgcaggtaccatagttgatagaagtgaacggaagctgattgccggagcgtgactgcagggtgttcaagttgtgatacatcccttctacagcctgataacattccttagtagtcatatcgatagcgtattcatacgcatcgtcggctactttatagatgtctgcatcgattgaaagctctgggtcaaatgaagtatcgtctgggaacggttctccctgaacgtaatgcaagccgttcttaaaatgcttccagaacgacttccgcacataaggaaccattgtccagtcaagatgtgtcgcgctcacaccgccgaactgctgtaaggactgaagctggaagattaccgccacgagctgaaatgcggtatttacgctctgcgctgggcgaacatccgtctggcgggtattgaagccgttcttcaacaggtcgtcgaatggaatcgagaggcagttatgtgatccaaccgcataactgttcaggtcgtgaatgtagatctcgttgttctcgtgattgcgtcgagacagcggagaaacgagatactccagagcatactgctttgttacgatgtcacttgcctcgccaacgcgaccgccgaaactcatctcgtctacgttggcgttctggtttttgacatccttagcttgcagcttttctgctacggcgtgcatcagttccttgtactgacttcgagccatcttgtgaagctggcggtactcgatatacgccttggcgatatccttatacttggtggccatcagtttcttctctacagcgtcctgaatttcctctacagaaaggttcttgctgattgcttctacctcgtctgcaattttctcagccacagggtgtgcaacgtctgtagaataatcattatccacgaacgccttcaccactgccttaacaatcttgtccttatcaaatggcacttccctgccatcgcgtttgatgactgtcattcctcgtcccccttacttaacttcttcgcggcgcttttcaaagtagccgccctttactttttcgatgaaatcgctggcctgctgctccaagtcctgcatcgtgccgttgttgacaatcgtgtaatcgtaatcgtactggtcaacatcacggtcggcgtggttgctctggattggctcgtaacccggccgcttaatcagcaatgtcagagcgtcaaaacgttccttggctcgcttaatctcctccggttcacggatgtgcatgaacagcatgacgttgtcgtgatccttcacccgattgaattccttggtcagatactcaagcggcgcgtcggaatactgcgtcgacaggtctttcaggtcagacaagaattttctggacttgtcgtccttctcaccgttccagccaagccgtcgagcgacttccttgatgatatctacagagctgatctgtgcgatcagcatatcgtagaaataagcccggtctcggcacaaagaacagaatgtgtcctttccgcttctcgcgggcccatttacaataatgatatgtgccaacttattctcccttctggcgggtcttcggatgtccgcatgtcatgacaccctcgggacaggagccggaaacacacggtgcaccggcgttttcaaagatagtcggcgcaaccttctggcataaaactaacatttgctccgccagctctctaatctcgtcctgtgcgcgattacagcaccgtagagcaaagaaactgagcaattcgcgtgcattcatggtcacagagaacgacgttcctgcggcatttgggagcacgcagcgggcattctcgttagcgtatttttcagccgccgagcgatccttcttgtactgtttatacagcgcttcatcctcgttcttcttctgctccataatggcgtccaactgtagatagaagaactggccgttgttgcggaactcgatattaaagtcgccgatagcgtactgtgcatacttctcgcggagcttttcgctcatgagcgttgcgtgaatgtcgctgtaggtcgctctgatcgtctccatgcagttctcgaacatcagcttggcggccagattattctttacagcctccggcatcacgaattccggctttgccatattgacatagcgctgactctgcactgagaaagatgcaatccggtggcgcgtaatctgtgcaagcagagagcgagatacaccgtcaataccgaacgtgaaggatgcatgctctaaaacagaagtatgaccggagcgcttgatctgtcggatgaactttgccgcctgttccggagtaatgtcttccagaatatccgcagccttgccggaagagtaacaacccttgccggccgccgcgacaacaagttccggcattggtgtccaagcgagtaactttacgttcacgcggtcaccttcttcttgcgcggtgcggtaatcttgagccagctctttgggaacgtgtagttcttggagccgttgcactcaacgcttaactgaacttcatcaggatgatcggcgcagagcttgtccatcttcttctgaagcgcagggtcataggtgaacacatgtgctgtgtcgtcctgctggttgtagtctacgatggtttccatcgcagtctttgacatttcttccattctcatcactccttgtgcttatcagggttgttaagtttcgtggaacacagacggctaatcttagccaaggccgtctgataatccacgaggcgcttattaggctttttcgccaaagtagaaatctcttggttgatagcgccggtcacggcactgacacccgtatataatcctctgcggaactgaagttccaactgagccttaaactcctcgctaatttgctcggcgggcgatttttctttctctggcggcattttaactacgtcactcattcacttcacctcaaaacaggtcgtcgatttcgtggatgccattatacgagatggcacattcttcacagcaaaacaggttgctgtctttatctttccagagctcccaatccggagatagctcattgccgcagttttcacaatgaccgataatctccggaacatagtcgggatctcgtggattcttagggttcgggaatttaggaatcatacagcgtactttgagtcctccggcgtttccgcgtagcatggattctgcgtaatcggcggataataacttccgtaatggttgtcgtctgtctcatccgtggtgatcgtcgttcgagagacaaccttcccatccttgtctaattcttcagtgatttctacaatgtgtcgcttaatcatgtcttcctccttatccgaccagatgatactggtcgaggtaccaatagccggatttgttcttcgtgcatcggtcaacgtaaatgatgctgccgtttttgattggattctggtcgtactgccgcgaacgaagcgtcaatcgaatgcgcttaccagaaccaagcgactgtgtaaagcaagcataaccccacggttttccggtgtctttactcaaaagtggccggaaatccgacacgagaacaagtctgcggtcttcttccttccctgtctggatgtctacatagccgagaatatcctgctgattctttatctttacgcggaacggaagatcttcgatacctgccgccaatacgcggtcttcacattcgcggagcgcctgagcgacgattcgcttcagttcctcagcaatttcctgctcgacagcgataagctgttcttccagttccggtgttgggctctttttaagagcggccgcgagctgctttttttcgtctttcaaggcactcatctgcaggctcgtgaacgtatatcttgtcgctggctggccgtcctttttgaggccgtcggcgtacttcggtacaatatcagccagaaagctgttatcaacgcgctctcgcggcatagatgcttttgcgccgtatccgaactcctcgcacagggcgatgatgttcagaacctctcggtcgttgccgtagcttgagaagtaactgatttgagccagaggttcagttgtggacttcataatactctttggtcggagagccagaagaacgtcggaaaggtacttcggcggctcctgtccgagctcataaagagcaacggcggcagctttattgaatcccttgatagaggtcagcgcattgctgattgcgttgttctcttcgtcggcggttacctttcggttatcctgaccgaatttgaacggcgggaatttgatattgaagtagctttcggcttcgtctttggcagcggcgagtttgtccttgtcgcccttctcgtccatgatacgcatgaatgcctcataaaaagcgagtggatgatgtgctttaagccatgaactatacagagaatcgagagaaacgctgtaagaatgcgcagaattatagctgtaagaggcagaatcttcaataatcttccataccatattagttttttccgccgcggcgctttcatcgatgtgttcctgctcaatcaatttcgacgcaaaacttttgatgaatcgctcatgataagcaagaactttctctttacgtttcttggcaatgttcttaatcgccgcgtaacattcagacatcgggaaccctgcatagttcagcactgccatctgctgctcctgatacaagcagaacgactgcggtagctcttccgtgcgaagcaggtcgtcgaacggtttaacgtcatacgagaagtcctgtcggctttcgaaaatcttatacatcgatttgaaacccggacgaattgcggctatgaacgcgcaaagctcggaaatattggtcggcgcgtaaacgcctacgcggctggcggttcccggctgctcaacctgattgatgccaagtgtgcagcccttacggtagatatcccacacggggtcttccggcggacacatagcgagcagttcatttacggttggaactttgagacctgcgcgagtgtatcccttattgatcaggtcaaccacagcaacacggagtaagtcattcttcaggaagtgattcttttccgcccagtgaccatccatcgcacagcagattctgtccttgatctttacaagaccaatcttgcggcgaatactgccctgatataacaggaacgcgcacggtgccggtgaccagctcgtgatgatgccctgatactctgtcgagcggaggtaaacgtcatggaatcgtttgtcgatatagtccatgatgtcgatggtgtctttctcttcttcatcgacggtatggagtttgttctcataccgcttgatctgggcggacacttcattcgccgtagcgaagtcgatgttctgggacttcgcaaacatcttccacgcagctgacgctttttgagtgccgtaagcaagcatctgaactgcatgatcgcggccgcagacctgagcctgaccttctgcaaagatatcctgttcggccacattgaagtcgatatccggcaaactgtgggtttcaaggattcgagttgcggtcataaagcgttcaggatacatctttaccttggctgcaattcggtcaacctcagtaaatccgagcagcttattggtaaagaagctaacggcgctgcctcgaccagtgttggttaaatggccgccgagctcttttcctcgcctgataacgtggtaattatcaatgaagtagtctgccatgtggcactcgacaaccgtgtcggtttcggatttgatctctttttcatattttgaaagcagatccggggcgacctcgtctttgtagctctgccagccttcatccaccagacgaagatactcggcgtttttctgttcctgtgtccaatctgggtggagcgagaacagcttcagactgtcatcaaagatgtcgcattcgtactcctcaacttcgaggaagcagttcgtccggttgattgcctccgcgatctcagcttctgtcaagacaccctgctcacggaaccgttggacggcggtgtcgccatccgggtaatccatgaaccattcttcttcatcgtcgtaagccttgcgatcttctttggaaacgaggaagtcagagcggagctctgcgccgttttcctcgatgtagtggctgtcgcagcccataataatcggcgctggaatctcttttcgcagattcagaatgtaacgattcagctctttctgtcgctcagaggggtggtactgcacctcaaacatgaaattgtcgccgtgtttgtcgtacagcttcttccagagggccttgatccgctcttcttcttcgccgagatacttccatccggcaacacaggcggttgtaatccaaacgtcgcccgccggaagcaggtcgagaagctcttcatccagtcgcggctggtagtagaaaccatcctcgttcgcttgactgagcacctcgttaatccattcgcggccgttttcgttcttcgcgccaatccaaatgtggcagttagaacggtcttcttcatgacgatcccagacccagtaagcctcagcggcgaacaggaacttcagaccgtactgttttgcgagatcgtaacactcgatatatctcccctgccagccatgttcacaactggacagaatggaatgcccgagctcgacagctcgctttgcgtaatcctcgtaggtcacgaccgagtcgctgacgcgaggattactataagttgtgtgtttgtggtagttctgaaaaactatgatagccgctcccttctccgatataattcattccaaacttccgctccgttatctacgggagccatcttttcgcccaacaggttgtcacggtttcgcacccaatccactccgcaaaagcgtttcagctttttgatttctccatcttgtcgcgggtcaacctcttcatcgaacgcgatgacaacacggacgcccagctgcaggagaatcttggtctggtaagggttaaggtgtgaggtcagcacagcacagcagttatcgaaaccgtagccagccgccttgagaacagacttcgcgccctcaaacaggatgacctctttcttccggaggattgcttcgcggttttcgtaaagcccgaacaatgtatcgagcacgccgagctttacgagataggtgtacttgcggagcttcttctctttgaaatcagggtcaagtgtgcggccgcagatgctgaaaatctggccgtcgggcaatcgaatcgggtgaacgatgcggtttgacagcgcatcatatcggtagccgaatcgcttcatctggtcgagagggataccctcatcaagccaagactggaacttctccggtcgccattcgtactgctccatcacattttcccctaggattttgtgtggttcacacacatttttctgttcttttcgcggtgcgtacttcttgagagcctgtacagccgacagatgggtggacggtagtgacacaccctctgtgattccggcgtaggctttgagccgcttgaccgcttctcgcagagatacatggttgtacagcacctcgaagtcggcaacatcaccgcgagcaccgcagccgaagcagtagtacaatcctttggagcgcgtaatcgtgaaggaaggtgtgttctcgtcatggaagggacacagcgcgacgtattcgttctcgctgcgccgctctacatcgaggtactgagagatgtagtccacgatatcaatttgttctaccacatctctgatttccatggttactccttcttgtttactggctgagttaatgctcgttctatgctccaatggtttttattgattcgctctctgatgacctgatgaggaataccggtgatagcttcccactctttgaatgtgtgagactcaccattatattcatgtttctgagcattggatattttgtctttggacaaagcctcttctatgggaagtcctcgatttaatcggttaatcagagtctgataattcactccggactttattgcccattgatttactgacaaagtttctccagcgtaggtgtataagcggtctgtcttacgagactctggattcaatgcttgctctataggttctcccgcatctatcctgttgaaaaaagaagaaggatttatcccatactctttagcccattgcagttgactcttcgtttttccgttatagaataaatcagggcgtttgcgaaaactgcgagccggggtggtgagagctttttccaatggccattcatcccttttaattcgagatttaacagttcccaaattcatcccatattcatcagtccattgcctaagcgttttagcctgtccattcatttcatagagtctaccaatatatcgaggttctttatttctttcccttttgtgctgagttgacacatgaacatgttttgtgcttctcacaatacagtgcttctgtttcagctccttaatcttttgttttgcttttttattacttttatcatcaaaaagcggcaatttagttttagtttttgtaggtttacatttgagagagataggcttcattctcattttcaacccataatccggtaattttcctccctgtggaaatgttagtaccaacggaagaggccattctttttcgatacgcaattcgagtacatttttcgaaatacctgtttctcgactccaatccgaaagcgattgtgtcttgcctctaaatgtgtacttctttacattgcgtcggttattgttctgttgcaaccgtgtagcccaacgacaattttcaggtgtataccctttttcgttatctctccggtctaaagagagatcgtcagaataaccgtgtgttaacgcccattccttaaaggcaggataattgtgaacccattcgtcacagactgtgacccctctgcctccataatcatgataatttttagcattggggttgttacaccgggttttcatggccataaaaattctatatagccgttctctcttgcgccctcttgtagcgccatgcattattcttttctttcccgacgttattctcacctcttaatatggtgcattggggtcgtgctgctttgcggcttgtttgtaggaaacaaggttgccgttgaactgcagatcgatgtactcattggaggacatctgctcgccgttacggttcaatacaactttgagttttttatttccacattcaatgccgtcttgactgatctcctgcggggttttgttctcaatggtgagaatcgtagaggcgtttcgagcaatctttgcgctgtcagccagcttaccggttgaagttgtctgcgcggctccgagaccaatcagtcccatgtcaccgcaaagaacattcttaaccatatcgaccagacgcccgagttgctgatatgtggcgaatgcgtcatcagaaccaacgccgcctccctttgaaccaccggctcctccaccagtaccgctgccgccacccttaaaataatccactatcagaacctgcgtcccctgcgaatgaatcgacttcttcgcggccgcgtaaattccattcgggtcaaaaatcggcatatacttgtgggtgaactttctggttttgagccaacttctcgcctgttcaaggcgttcactctcttcggcggtatattggccggagcgaatgcggctgtattcgatgccggttagattcgacataaggcgctgcgtgaacatacgagagcttaactcgctgtccagatacagaacgctgtagtctcgcttcaaaaggtcaaccgcctcgttcaataaaaacatacttttaccctgcttagcattcgcgccaacgatcactaattcgcctgcttcgagctgaacgtagttgttcagcgccggaaacttgaacggcacgccggccattccattattctggcggtctacgatttcctgccatagttcgtcaacgacgtccttataagccggcagctcgttggtcgaggaataatccatgagcacgccgtccagaatgttatagatcttttcctcgatatggtcttcgtcctcgctgaagcaaaggttctggcactcggcgagctttttataagcatcgcgccggaacgccttatccaacacgttgttgactgcgagcatatactcagcaaccgagctgcgggcaaccatacggctcatctccatcagctcgttcagtttgcctggggtgaactcttccgcccactttttcatgttctccttggagtttagaacgttcataaggttgtaagggtcaaccttttcgacgttgttcttcgcaagttccgtaatcgcataatagaggcaggcgttctccggatctgtaaaatggcggggctttaagttttccgaatggaagcagaattccggatgaatgaacaatgttgaaataacaccggcttcgctttcaacacttttaatgtcgtttacattgtttacgttcaaatttaacctgctttcttactcttttcctctttcttcggtttcacataagcggaggacatcgggcaatgagatcgcacggaacagatttcagcgcagaagaagtcagccttcccggcttttttcgcgtccttggcagatttgaagttctcacgcgccttgatggaatgcttgtccagccactcctcggtctcgcaggcggtctttacagactcaatgaaataatccttagccgcgatgcagtcccctgctgtgcaaggctcgatgtaatgcttctgccctcgaaacaggtcgaggtctgtgtaagccggccagacacccatcttctcatggacaaggtagccgtagaactcaagctgcttgcggtacttcttctcctctgctttgctggcgaacttcttcttactcttatggtctacgacaatgtactcgccggtctttttgttcttgaccagcaggtcgatataaccgatgaccttgaagccttcgatctccgccttcatctcaagctctacgccgatgacttcatagttcggcgagagccccttaaaatgacgggcgaacgcgagaccgtcctcatagtaggatttctcaaggtctacatagcggttaaacggccacttgagcgtgatcttggaatcgtaatcggtgagatacagttccagaagctcctccggctgcatgatgcctttgaacaccagctcgagccattcgtgcatctggctgccgtactgggcaaatacgttctcgtcctgttcaatcctcggctcagcgagccgctgaagatagaagccgtagggacattcgtgcgcttgcgtcgcagaagaccagctccagactctattcttcagcttttcggtgaattcgctcacttaaaacggtacgtcgtcggactcaaccgggtcgccggagtagccctcgtcaatactcggcttctggttgccgccgttgttctcggacttgctgccgcagaaatttacctcatcagcatgaagcgaccaagcaatgcgattgttgccgtccttatcaacaaacttgcgggactccatagcaccggaaatagcgatagagctgcccttcttgaaatacttggccacgaactcagcggtcgcgccgaaaacggaaatgtcgaaaaagtcagtcgggcgattgccttccttgtcacggtaagtacggtctacagcaacagagaagttgcatacagaagtgcctgcattggtggtcttgagctccgggtcgcgggtcaggcggccaataattacgatcttgttcaaattcttttctccttcttggttgttttacttcattgccttaatggcggtggtgatttcggtacagagcgcgatggtcgggatttcggtcggcgaatcgttgccgttgttcttctcagcaatcagcgcgtaaatcttggcgcggtcaacgcccttcttaacggctgcctgcgcggcggaaacgaccttcttacgagcgtcggccagaccggtacgttccttcttgacgccttccggcatatcctcgccctcgtagataaataatccgaggccgtgctgtgcacaagccttagccagcgcacgcatttttgccttgttggcgtcggtggaagtgacctgatctgctttcacggcgttgttcttgaagtccatgatggcataggtttcctttgcctcctgaccattgatggtcacgctgacctcaacccatgcgctctttccgtcgtcaaaccacggacgcggctgcggcgtgcgcttgacagtgcgggacataaccggaacgccgtccttgaactctgtggtggtttcctcatacggctccggctgacaggtgtagacatgataggtcgcgtcaggataacgcttcttgacttctgcccacgcggccgcccagctgatgtacgacaaaccgttcttcttctttacctttccggtgacatctgcgtcatacagcgtctgaaaaatgctctttgttgcttcgctcacttagcttcctcctgcttcttttcgcggcgcttctcgtacttcttctggcggcgcttcttgaaatactcgaggcgcttctcgtgcttcttctggcgtcgctccttattctttgcgagacggttctcgctctgatacttggcgcgagacttctgcttcgcgcttggcttgtgcttgggaatacccatgtttgtcactccttaactgtgattctgtatatttaaccctttgccgggtgtgttgtctttagtgctccacggtaatttcgagcatgtggctggcttccatgtcggctagctgaagcatcggtacgagcttgcacttctcggctgccgcgttcattgctcggtcgccgcccttaacggcgttgtcaaaaccgttcatgtgccatcggattgccagatactcatcgggcgtcagcttcatgaactgctgaatgatgaagcacgatttctcgccatggccgcccggaaatacctcatcaaacttgtacgacatgtactgctcccagcggccgtctgcgtctttgcggaaggccggctgcttcttatacgttaggcacttgcataaatcatgcattaaagccgcgatcgccagtgtttcgtctgtgtattcgaacttttcgtacttctgatgaagagccaccagacaatcataaacattcagcgaatgctcacagaggccgccttcatagttgccgtgaaatctggtcgaagacggagcagtaaagaaatcattgttctccagatagtgaatcaaatcctctacaccgtcgcgctttacattgtcacgcaggatctgcaggaactcttcccgattcttggcgagctgctccgggcttaaaaactgtgttttgtcagtcattacttcgccgcctttccgtaagcgcgacccagaaccttttctaagcgctttttcaggtcttcgacgcatcttttttcaattaggtaatctctgaatgcgatctctgcatcatttttggtatttttaatctcggctcgaatagatgccaactcgacaccataagcaaggtcgaaatcatcacccggattgcaggatgcagtgccaataaagccatcgggcgttctcacttttacctttgcagactgaccatctggacgactgacggaatactcataccactggtcttcgccccatcgcttccagtcagtccactcgcgctgtttcttcggctgcttacttgggtgccatttagtgccgagtttcagcattgctttgaaatcctcgtaagaacctgcgagacaccagagatcatcgagttcggtttcggtgtagtcgccaataagcgcctcgcttttggcattcttcttatcctttttcggctcttccatgccgataacctcgaaaaaattgccgaactcctctgttggcagggtgtatgacgcctgcatgtaagatcttgaatcggaatagcaccgattcaacgtaatagactcggaattacattctgcgacctcgaaaacgtctccaatccgatcatgattgaagaacggatgaataattttcgcgcgtgttcccttcgctaatctcataaaaatccctctttccgtaattctatctggttgtttaatcgccgattccgtatttttcggcgtatttttcgatgaactcgatcatctccggttcctccgggaagaatgggtcacggccttgcgcgtgcatagaccccaagcagttcatcatgaactgaccgaagcgccagtccggcagcttcttccatgcgatcttcagccggtcgcagaactcatcaattctcgtcggatttctcatactcattcttccttttgtggtattctctcatgtgctcactcgctttctgtggtcgctctcgttttttctctacatatactactatacaaaaatcgcgattttgggacgcgaaaatccaaactttttttgattttttgaaaatatttttggatgaagggaaaataaacgccgcacagtcgtgcggcgtcttttagacgtaatattcagccatgtcttccagtcgtaagcaagccagtcggcgatacggattcgtcaggtttccgcagccgcagtcgatgcaaaggaatcctttgccgtggaagatgtggtacggctctttgaattgtttggtcagataacaggtcggcgtgtgccctactatataatgtgcgttgccgaaatcgtcatcagcttccaccctaccccagatcatatcgaggaacttggtagaaggtcgcccatgaaccaaagtccatatcgtgccgttaacctcgacggtctccattgctggccgcttgtggcaataccgaaggatttttcctcgctcagcagtggtgcggcggtaaagcagatcgcggcgagtcttggttcctccgtttgccgtccacattctgcgagcctctgggaacgagtctttgctcagcgtgccgagcatcatatcctcgtgattgccgagaataaggtgaatgttacccttatcgatgatttcgagaaggatttctacgccctcggctccccgatcgattacgtctccgatgatgtaaagctggtcgtccgcgctgaagttgataaggtcgagcatcgcgtggaaacggtcaatctcgccgtggatgtcggccataacgtatgttgacattagttgtcactccttgtttctgtcatttatttatggtataattcaataaagaggtgagatgatgagccagtacaatgacattctgaagcaatatagactctcgcaaagcataaaaggggtcgccgcggttttgaatatctccgagcaaacggtcaggagaacactgattacagctggtctgtatacttccgaacgggcaaaacgtattcaacagctatatgtggcaggtatgccgattaaggacatagctgaacttttgaaaatatctacaagtgcagtctcctcttaccttccttataggaagggcccgcgcaaagactggggcactactgtgaacgcaatgcggattaaaaaatgtcgcgagcagaaaagctcgctcaacaaaattctgaaagctgacgccaatcgtcagctttttttaaccgaagaagccgccggctgccaaaattgccgcctcgatagcgcagccaatcagagttgtccaaccgttatacttgtcgattctcggcttgttgtgatatatgaagccaatggtgacgttggctgccataactgcgatcatgataacctgtggaattcccatctttatttctccttttctttcttttccctaaatttctttgcttttttcttgaacttcgtattgaacggttccggcaccggaaactctgcgaagtcgcccttcatcagctcgtcgggattcttctccatctctttaaggatggcgattgccccggccgtgttgttcatgcagtataacttcatttgatcttggtggctttcaaaccagccgcgaaccagatgaagtgcttggcaaaagtagcggcgcatcggaagcggaacattcgctccgtcgtccagatactcgccagccataatttttcggtatagctcctgcgcttttgggctgaaatctgaaatgtctttggtcatattcaatctcctattatgatgaacccgatataccaccgcagccacgcgaactctatgctgacgtagcagtcgccaccgtgaatgttgatggtcggtaatacgtagaagtcccgcatatatgttccttttatcatccacaagtccaccccaataccgcaagaattaaaatgctaccgattacacaaagttggccagcagattgtttcaacagcgccttattatcgttttttccgaacatccactcaatatcagagtcccctataagatggattcctaccacaaacagaacaaggccggcgagacatagaaaagttctgagcattataatcatgtgtgtctccctccctctttcttcgacgcgttctcttttaaccacttgcggttcgctttacactggctgcagttgtttcggttcttgcaaaaccagcagccgtcacggtcgaaccaaacatggtgcggtacttctgggcgaggctttcgttttgctttacccataaactgtcacccccgatgatacaggccagtcgcgtcggtgaaatcaacgtcgtcataaccctgctgtgccagcgagataccgagtttgacggccttgatgaagtccagttcatcgaacaggtcgcggccaattaccgcatcctctggacattcattcaagttccatgcggagaacaccatactgtcgttctggtcgaacagggatacgccaaccgcgaaatcatcctcatcggtggcgtattcggcattgaagttatagaccttttcgcccattgtaaatcaccccaaattaaccttttactgccgaatgtaagatactatgtttttagcgcactgcgaacaaacctcgttgtaacaatacgacctgttgccatcgtaaggaattccgttcgtgagcttcacatcgatcttgtaaatcggttctgtaacaccggaatgtatctcttgcccgcagatgtcacaaaatactctggtcattatgattcgctccctaattgttcaatgtacgcttcaatgttgtctgcgcaatcaggacatactaagttgtaggtctcctctacgagacgccctctgaaaaacgtaatctgatagtcttcgccgcattctcggttactcaactctttaccgcaaacgtcacaaaacaatccgcttccttgacttgatctaagtccaatagtcgagatagcgtcaggatcttcagatgactctcgcaccgcaaccgaacagccagttaatgtcaccaaggataagcaaacaaccgtagcagcaataaaaatcttcttcatccgtacacatcctcataaaagtaatcaaagcattctgaactgcaaagtcttcgcccaaaacggagatcggagaattgagttttcttcccacagatacagcatggtaagctgatctgatgcttgagaagtgcgtgctttgcttctccgactttcatgtcagggaatcgctcagaaaagtccatataaaaacctctttctagtaatccgaaaatcagtgattatcgaaaaccttagcaaacgaaacataattctcatggtttgggtcaggtattgcgaatatgacttcagcaaaaggatattttcctgcaaggtctcgcatgatctcagctacctccgttgggttctgtccaaatacaccgcagccgaacgcgccaagaaccagcgtatctactttctgcactgcggcaacgtccaaaacaaagcgaatacgagaaaataaggctttgctgttagttgcgggatctacgttcgcgtacttggcacctgcagaaaaattgggagctgcacatgtaatgacgttgcaggtcacatctcccccgttgtggtaaaagtgtacgtcaggggcataaatggcgcgattggtgtacattgctcggcgtagcgtttttcgattctgactataatactcttcctcaaactcacacaacacattatacaagaacgactcgtggcacaggcactcttcctgtgcgcggctaccctttaggaacataccgcctgggttcttgtaggacgcgaaattgagcacggcgaccttttgcgagggatgctttgctttgcaattacagagggccgtaacagagtcttctgcgagcaagcgaagaaccggcacagagatgggggcgcctggcatgaaaacgcgcttgcgcccatcctcatcatcgtagatcttagcgttggcaacgcttcgtcttatttcctcgctgtgttctctcgtattcttagttgtccattcggcagcccttttagctcgtgcctctttgcctatccaataattattatttgccacctgattcagttcctttcacgctcagatttacttttcgataataaattgttgtaattcgctgatcatatcgtcagccgtagcgaccctctcgggcgatacggattttgtaaaggagagctctacgtctgactggacagttccttctattgtgattttgcaattaggtacaaaatccgcaggaactgccacttcaactacacctggcctgacttcattcctgatttcggccgtttcgaaagaacaatcaatctctccgagtctgaccgagaataatttcatgccagccacatatatgtcagcaatatcgtcttttcgaatttgtggaatgtaatgcataatcaaatcagcctttcgtagcttcgtcataaatggcgtccgcattgttcttcatatactctgcgataagagcatagcccttcgtattggtttcctccgggaatcctctaaattttgtacggtaaacattagcgacaacctgttccggatctgaaattgtttcttccacggcgattgtccatccaaacacatggagaattgaattgacgagccaaagaaatccttgttctcggaattctttccatgtttttaattctacattcttctcctcttcactgggagtggtatagtacggcttgcttttcataattcgttttcctttctataagcaagaaccaacgcggtgtataaaaaatgttctgaagactttctgaacacagtttgatactgaacttcaacttcacagctatgattctgaaaatcctcaatcgtactcgctaagcgtttattaaaatcgtccgcggaaccagaagtaatcattgctgtgctcacatattttttcacgttacgcacctctcatcgtacaaattaagtggaatccgaatgccatccagaacagaaccgagaagatgaaacacgattctgcggcacttctaagctgccatcgtagaattcggtcgccttttactcggccagaggacgtgtttaggataaacccggccacaccgaataagagtgcaataattcctgctgtcataaaatctccttatcgcgcaaagtacacaagtatcataatcatcgctatgattccgagaactgctgcgactagttcttcttcttctgttgacgcattaacaataagccaatccattgtcacagttataacgaagagcgagacccagaagatcatccgaccaccccgagcatcatcaggatcattagaaccgtgcagacaatcagtgcgtacacggagagtccgagattcagtgcgtcagcacgagcttccgggttcctgcgggcttctttaatcttcccacatgccttctttacgtccatgacagatagagcaaggaacgggatgataagaacgagccagtaaagttgcatttggattattcctttccgttagaataagtgtattttcgccggagcatcttcggagaacgctcatcgtgatcgatgacttctgcctcatcttctggttcgtattgcagcaaagcagccgatgtgtagctgtatactccctcttcgtttacgaactccggcattgtcacccaaactgtgccgtagtatgggtcggcgattgctacataagtaaagtcgtctcgcacaaaaacgtcgccggttctgagattgttgattttttctcgatatggaaaactcatttttgctctttccccttcattcttccttttgcttgtggattaaccgcgagcattaagccagcttttattttgttctccttcgctattactttttaactctgctaagctgcaaaaatcaaattccttggagaggaataacccatacggattaagacaatctttaacgccttcctctcctactccgtagaatttgcagtctcggcagtaaatgatttgtctctcaccagtctgcattgataaccaccttatgacctctcagcagagcaacagccacgagcttttcgatgtcgttgttcagccaaatcttcttaacagaatactcggcaagctcacgagcctgttcgtccgtgagtgccatgtctttgccgtaccagtcgctatcgccgtatccattataataattgactgacctcaaaaaatcgtaccagttagaccctccgacactgacctcattgacatcctttgttgtgacgagcttgccgcagtctggacagcgaaattcttggacttccttaatcgtaacgtcgagacccatcgtcgtttcctcctccataaagtcgtgtgccgcagtacgggcaataccggtaagtgttgattacatggttgtccagattgcgcttgtaatgacatcgaggacagatgtgatccatccagccattgtccgccagctcaacaatccagtggtcgtgtaaatcgttgtttcgttcttctggagttttccagtcttcaatatgctgtccccacataggattaccctcccaaatatcgatgaagctgtcgtacattaccaatcttcctcggaatcgtatgacggattgaacgggcagtcaccgcagcgagaacgaagttcgccgttctcatcctcgtaccagtcatcaccgtatccggtgcattcgtaacagtagtcgttatcgtcccacatgtttatctcttcctccacacagttgcgactggtctgccgcactcggggcacagaacgaataattcccggccgtcgtcctcgcccttgtagccggccgtgccctcgtaatggatatcatccgtcgtgtactcaaacacacattcacatccaacacatctatgtcttcgtgcgccgaattttccgtgagtgatcactttcacagctcgatcccctcaacttcagcgcggatttcaaggtcgtgcagatattcgcccatgtggcgcttctgctgacggagcaggtcaagagaacaattaggagtgaagtcaagcgttccggcctcgtacttcgtcaccatgcggtgcagcttctcgtagcgggtcttgaggtcgtgatattcggcctgcatacgttcctgccagctaggctcaacagagattgcttcgcattccttctgggcctcaacatcttctgtttcaggcaattcgtatgttttctcgaagagatctctaccccaacatataattgctccgaaagaatttttaataatataatctccggggtagacataaattacatcgccgtcgggatgagtaagggttagataatcgtcacctcgatattcaactacacagcaggacgattggcacagctctttgattttcttaaagatacgaaatccagtagtccactgaatggcttcgacaaattccggcttctttcgatatttcatattttgttcccttccgtgttaataatacgatgaatatactttcgtgacagcgattgatgaaccgcagtctggacacactataaatccgcagccacgttgtgcatcgatgactatttcatcacgttcacactcgaatacacaatgacatatttcgcaggtcacccgatgcacaatcggtttcggcggctcacgaaacccgtgtttaataattttcaattttctcgatcctccggcttttcaaaaattcatttcgaacacacgaatgatgcgaagaagtcgttcatccagataggattcagctttttctcgtaattcttgtggtacaccatagtatgcttcggccacaccgcctgtaattgcggcaatcgtatcgctgtcgccaccgattgaaatcgcgttgcggatagcatcctcaaagctggtcgattcaaaaaacgcttcgagcgcctgcggaacagtatcccagcacgtcagagaatacgaatacgctggtcgaatgtcatccagagtgaagtccattgggtaaaaatagtcgttgatgtggttcttgatctgttctttcggctgcccgattcgcgcataatacgttgccacagccaccgcgctggcaccaacgagcgcgtgtatattgttgtgtgttacgccggtaatcgtatccgcgagtgttatcgcctgttcacgactttcagcaacaaagccgacaggagaaattcgacttgcagctccatttccatagctgttggtcggctcattagatttgctattaacccaatcttcaaagcgtgtgccgtagtctgcgttagggtacttctttgcaatgccgcgcatccacactcttgcgctcttctgtaattgtgaataacttggtcggccgccatctaacaatgcacctgcgacagcgactgtcagaaccgtatcatcagtgaagtggcagtcgtctgtaaacagctcgaagtctttggttttaatgttgtcgtactcgaatcgcgagccgacgatatcgccgataattgctccgatcatgctctcacctcaaacaatggttttattatggagctgacactcagactcgaactgagaaccgtctgattacaaatcagatgcgctaccaattgcgccatgccagcatataggcccgcgaaacgcgggcggtgtttatcgaatgtcaaaatagctaaatccacggacttccttttgagccgcgagatttgcctcgtacagccccctaaagaagtgctttacgttctgctttattcccactaaaatcaccgcctctctatcattccgcaaggtttaagataccgctttgtcgcggcagatctaacttaaatgcgagtttcgctggccgacagttggtcagactgccgggacagcgattctctatccccttcactattccgataggacatcgtttgaccgacggctgtcgtaccggcacggtaccattaagcacgttgcctaaccagaccgtgccccgtctttcttcgctttcatctggcgggataaccggttgaagctgctttcgctggcggcctctgcctttagcaaccagtaactcgggaatagcatggcatagtatcccattccctacaaacgctcccgtttcaactcaggcactttaatgccaacactctttcatctcagatatgcctttctgaaatgctctacgcgcgagcagcgctgaatcggtttaaccaaaacaccggaaaggttgtgccactcctcttttctgaatcgacaggaaaggtcagccgattctccctcgccggaatcgaaccggccgagcatcgtgccgcgggttgcgctcgccgtacatgggggagatatatgggtcacgcttaacggacgtgacgtgagagaacaccgttgaccaatcatcgtcaccttggtcagagaacagagccatctatacctgtggcggagcaggagaatttcgaaatctcacacccttgcgggttactggtagttttcaagactactgccttgcctttaggcttactgctccatgtggcttctcggtgaagaatcgaacttcaagccgctcgtacgaattgcggccgcaaccttgctccgagaaatgtggcgggacgtctttttatttttagtgatagtccgaggacatcccgcaggcacagactgttcaccgcagatgcttgcaagcctttttaacctgcggcgcaatttttaggtcttgcaggacttgaacctgtagctccaccgctttcgcggggcgtgttccctgttacaccattcgaccatgaaagtgcggtttaaggttaaccgcaaacctcgattacttgtacttttgaatgtactgatacactctggctgctacaacgccgatgcagaacggccaaaagatgccgataatgattgagcccaatgtgcagttgagctcgtcgaaataccgttggccttctttgtcttgcataacgaagtaattcgcgccgcagacgacagcgccgatgatgagatacattaaaatcagcagcatcacaaaagtccctccaatgccttctcaactggtttataacgctcgctgttgagcgtttccatcaggcattcatacgggtcgagcttaccgctcatcaccatagaagctacattctgactgaatccgctaaccagagcaacgccgagatcgttttccttaaccggaatggtgccggtgcgactgttgacattccagaacacgaggcgcggcagtttataaccggcagcttcatatttctggcgaattacatcgaacaggcgggaatccggccgcttgcggctccagtaatctgattgactgccgcaagttgcacaggagtcgaattccatatccgagatgatcagaatgttttgcggcatgtcttcctgtctcattcgattgttgaccgctgtggtcaaaatcaggttgaaaacagcttcgatgttggtgttcgccatctcgttatgctgcttggcgatcaacagcttctcgcgcaggttcttcgctttggagaaatcgaccagctgggggcgaccggaaaacgtgatgtacttgtccttgaattggccagaagaatgctccgcaaaataaatcgcaagtgcatttgctacgtccaatgcagttacgctgctgtgcgggtctacgtcgcaggtcatgctgccgctgccgtccgctacgacaatggtgttcccgttgccgtttaccgtatcaggcagagccttccaaagctgctcgagtgtttcgttgtacggattgattgaattccatacggaattgccatatttgctgacaatctcgtgcgggaagagcgtgcctgcgttaatcttggtttcgccctttgcgaggctttccagaaaagcacggcggcgctcttcgtcgtttcggagaaacgctttattatagatgaggtttgctctggaaggaaccgcttcgtacttgatttcattccactgttttgcggacattttcttctcgactacatcgagatagccgcgcagctcagaaagcatcttgcggtactgacgttccgttgcaccgagcattttctgaatctgctttgcataacgcttggttgtcgcagaagaagcacccggagacgggagccattttgcaagtaaggaaatcggctggccagcctttattgatttgaggtctctgttcagctgttcttcaataagtgggtatacttccgaaacaaggccggtatccagcaggcacagcaggtcgtcgtagcgaccgtattccgcaaccagcttgattactgggcgaacatattccggcaggttgtccgccagatacttcattacggcgcggaacaggcggcgctcgccgagtccgccgcgaacatctcgagcgaagaacaaccacttcattgcggccattttgtcttcgaagaacgccttgacgaacttgctcgtaatctcggcttcgcttgcgctgcggagcgaggctacggagaagttcagatcgagcagtgctttgccggttgttctgtaaccgaccgcaccgttctctgtgacgctgacgttgtagtcttcgttcagcgtgttttccaatgcagatgtgaaattcatggttgttttttcctccttttttcaattccacagggcgctttagaattcttaattatcagttaagtccttgaaaagttgctgtgagcgccctttggagggttacgggacacaaaggtattttgattaaaagtcaaagcctgaaagtttgctgtgagtgtccctgttgtacggcggactggagtcgaaccagcctatgtccttttgaatgtttcaaagttgctgtcagtgaacttgtcagctcgcattttcatgtggggatgcattaccgctttgctaccgccgtatattgatggtgcgactggagagactcgaactctcacgggcttgcccagcgggacttaaatccgctgcgtctgccaattccgccacaatcgcatttggtgttgccgctggggatcgaacccagagaaaagcgtgtttgagacgctcgcgtatgccaatttcgccacggcaacgtatggagcaggtaacggtggtcgaaaccgtttcttcaccttggaggggtgacgtcttagccgatagacgatacctgcatatcccccgcggtgacgagtcgcgggaggttcgcttgccgtgccaagcgatgtgtgtgagtggagtttgctcacggacaaaaaatttcctccgcacggtgaggattggtcgaggtgacaggatttgaacctgcggcatcttgctcccaaagcaagcgctctaccaagctgagccacacctcgttatcgctcgtcttttccgagctgtcagacgaaagaactgatgaatcagaactgcgtaggctgtcaacccacggctcggtcgcctttttctcttttacttctcggtgacttagaagaaggtgcccggaggccggattcgaaccgacaacctcgagattacaaatctaaaagaaatttgctgtcagtgaacttatcagctcacatattacgcgctctaccgattgagctacaccggacatattcagttggcggatttttgaggagccgcggagtcgaaccgcgagaaacttttttgcagaaagtttttttgtaaatttgctgtgcgtgcgccccgcccgtcgcacttaaattctgttaccgaacgctcctcatgtgtgccggtctttcccggctgtcagcggtctttcccgcggtcgccgcttcgccatcgttttttgtctacatatactactatacaaaaaatcgatttttgggacgcgaaatctgaaaatttctcaaaaaaattttttacttggtatccgttaccacagtacctccctgaacggtgacccaaccatgcttctcgcgggcttccatttccatcttcttgagcagcttatcggttagagacgcggaaatcgtcgagtttgccttagcttctgcctctgcggcaatctgctttgcctgcgcgtcagcctgcgcttccagaatcttcgtctggttctgcaccttgatggtttcctgctccgcctcagcctgctgcttcttctgcatcgccgtcacgcggtcgttgatggtctgctgcagctgctcatccggatgtacatcgataatagaggcgtcgatcacgtcaataccgaactcgtcgccgagcttctcggaaagagcctccgtcagctgggtgttgatcttcgcacggtcaccggaatagatatccatcatggtgtaatcggtcgtgacctcggaaatcttggacttgagaatcgtgcggacgcggttgttcacgatgtcctcgccgtccatgccgcggaacttcttataggtgtcaacaacctcgtcctgcttaaagcggtaggacatctggaagctgatattgatgttggcgttatctgccgttgctacgttaaaggaatcgtcgccctcactgccgtcgcgggaatccttggtcagaacgagctgctcattgccgacggtgaacctctttaccttcttggtcggacttacgacatggaagccctgcgtgagaacctcgtcctgtacgccgccgttcatgctgtaaacaacaccgacgtagccggtcgggattcgttccgtacacgcgaaagctccgataccgccgaacaccaaagcggccgccagaacaacgccgcctactgcacccttactcatgtttgttttctccttcgtttttgttattttcgtcctcgtcggacatttcctttatcgcatcgccgaagatgcttgtcaggacactgccgagcttcttaaacatagaagcgcagcacgcccagataaacaccccgacaatgatacaaagcgcatagaatactggattcaagtttgtttctccttaatcgtctggtggttaattcagcttttcgatttcaacatcgaaagcatcttttccagtagaccagaaagcgatcacctctgagcttgcatattcatcgcgcagaatcgtatcggccgggaaaacactctggatggtaaattccttgaacccttcgttttctgagacgtagtatttctcgcgtttatccttctggaatacgttgatcgtcgcggggcccatatcgccgccgaccagattgcaaaattcagttaacgtcatttttgatttctccttatagcagtttctcattacttccaaggcaattcgtatcgcctcgttgagagcagcgtctgttacctcgttgccgtggaagcctccgtaggcatagattctttcgagctccgcggctgtggtggctgggtcgatgaggcggatggcttggtcaagggtcattgtttttccacctattccatgccttaattacatcctcaaccgcactcgttccgacgcgctcgctgtcggctgcagtccatgtggttgcaccgcatttggtgcagagcactctcacgccgttgcttacaaacaggcgagctttttcaccgcagaagggacacggtttcagttcaatcattgtctgcacctccgtccatgtctgattttctttgtcttacaggtgttagtaacgcttttctttcatcccatccactcgcaagtcgcattcttaatgtagtttttcttatgccgagcatttccgaccattcgccgattgtatgagatacgccatcaagacatatcaaatggtttgaacgtttattattctgctgttctcggatcgttgcccatctgcaattttcaggactataattcccatctacatcaatcctatctatcgtaagattatttctataccctgctttgattgcccagtcgcggaatggaacatattcactccattcgtcacagactgttatccctctccccccataacttgcataatgcttatggtttgggttttcgcatcgcgagtgcatgccttcccatattttatgaagcctcgttttggtttcgtgatgagttgatattccaattctttcaattttccatcctttacaaaacccgtttctacgatagcacgaagctacactacactgtgcaactttcaagaagtcacacgcttctttttccgaattgaacaagtggatcaccccgtctttttcaattctataaatagtcgtcgaatgtgtcatagatcacacctcgcgccacaattagggcaaattgggtaaatctttttgtcactccatctatattcacgatgcattgcttcgttgccacagacagagcaatcataacaaaaatcgctattcttccagtgcggatgtacccacttcccatgcaccaccggcacaacattggcggcgggcggcgaggcaacaatctccattgccatggcaccgtcggaaccgtccacccattttgccgccatcaccgctcttatggcagtatcccgctcaatatattcagccattttcgcacccctttcccaaatgagttgcacttttctgcttctcaaagtaaaactcaatcggcttttcattctcgatcacattcccgtaaactacgccaaccttatagatgtaattttcgcgcagctttctcggaatttccgcgatgtagcgccggaatgtttccagcgtatgggctcgcttgtaatgattgcacattcgacaggacggcatgagattcgaaatatcatctgcccccgcatcttcaattccccatgccctcagtgggagaaaatgatctacttgcatatctttgtatgcaatctctctgccgcaataagcacagtgcccgtcgtatttgcggtatacttcttcgcggattttcttacttatcgccatcgtttttctcccatttctcaacatagcaccaactctggggcggacgcttgatgtcatatggcgctgcgccgaatctcgtattgcgtaatccggtaaactcgctcagttcccgcggctggtcataaatgagcaggttggagatatgccagccgtaaagcggtgttccgtgcccgtaatcccatagtgctccattttcaagacaagtctgtaatacataatcatcatcaatgtcatagatgccatacggttcgtttgccggggcaagtctatctatgcggtcacaggtaaattccccgatgactttgccgtgctttccccacgctccgagagcaacaccgctctgcgtgcagtagatatagcacttaaacggcgtttccagtttcggcttggtctttctgacttcaatggtcttttcaccgctggcaatcttctcacaccacttcgggcgaatgcttaacatcacagatttcattttgttcctcccattcctcgcaccgacaagttttcgtgtgatttctattaaccactgtaatccactgcttcctgacgattgatgaaaaaatgaataccctgtgcgcattcattccaacgatcttcatcgtatttaggttcttccgcaatttcgcctacacggtaaacaaaattgcggtcatatccacttgcgacttccgttaattcagagggcgaaccatctaattcctgaatctctatcacttttgctttatcacatcggcactttcttcccgttgcggaacttcgacgggcatcctctgaaatctccaacttgacaatgtatccgtttgcctttttccatgcgacaaaagctcctgtatctggacaagtcatcggaacaaaaggtatattgtctgctccgcgcaggtctgctccgcacaagtttgctccgtacaggtctgctccgcgcaggttcgcttcgtataggtctgctccgcacaggtttgctccgcacaattttgttccgcacaggtctgctccgcgtaggtctgcttcgtacaggtctgctccgcacaggtttgctccgcacaattttgctccgaacaggtttgctccgcacaggtttgcctcgaacaggtttgctccgcacaggtttgcctcgaacaggtttgctctcatcttttcccagccatccatatcctccataagccaatgtttatggtttcttaaaatttcatttaattctgttttcgtgtaagttttcattacataacccaaccttcgccatttgttttactcgccaaatctccgtttcgtaaccgcaatcggaaactcttcgatttcacttgcccaaagggtttcgccaccgagttcattccaaatcagcggaaaacctccgactccatcgaacaggcttgccatcgttgccggtcggccgaactgtttatacagtctgctaagtacccatctccagggcggcagtgcgatagaattccccatcgctttgtagcgccctgtgtttgcactttttttatgcaacttatcattcgaatccgtccatgttccgatatccgtccagttatccggaaatccctgcagcctttcatattcaagtggcgtcagtcgtcgaatgaatttatccctgtcgggctttacttccatcaccgccattggatcgtgcatgcagttcaatgtccggcacacatctggcgtgagatgtgtcgcactggctgcctgtccatttcctacacaaaccggccggaacaaaagcgggatttggtttccacctgttcccatgcgggcttggagtgtcggtacatgttggccgcattctctgatgacatcacaggcgtgcgtcatatcaaggattatgcagtcctcgactggatctccaacgctaaccgtagatactccggaagctccttcttgtttcgctctgctctcttcagaattccctgacacgctttcgcgctcaaaaagtatctcgggagcggattctcctccaaaatctgcgacaagtgcgattctacggcgactctgggggactccccaaaactgtgcgttgagtacgcgccaagcgatactccatccgtctcccatgacgcatccggcagttctccattttcccttcggaggttcaggaataacggcatttggttcgacaatcctcgcgatttcttcgaggactcggcggaaatcttctcctttgtggctgctaaaagctccgacgacgttttcccataccatgtatcgaggacttgctgtccctgaagctgcttcactgtgttccctcatttctcttacaagtcgtgtctgttcgaagaaaagaactgatcgtttcccctcaaatcccgctttagatcctgcgatactaacatcttggcaaggactgccgccgatgacgcaatcaacgaccggaacttcgcggccgtttatctttgtgatatctcccagatgtttcgtaaactcgttctcctctcaaacttgactttggttgtacaattcctttgctcttgcctgaaccatatcccagattttacagtctgggatgtttgcatttagatatttctctatccgctcagtctccaattcatgttggtgagcaaccataaatgttccatgaatacggccggtcggtttattacagtaactccattcgtcgaattttccgctgtaacgaaaatccaagatattcagcgtgtcaccgacgattgaaatcgttacctttggacttaggctgaagctggcacacaagatacggtcttcaaaggtttctgcattaccgtatcggaatgtccacttctgcgattgcccgccgccgaccatatcatgacccttgcagttcggttcgtttccattccacatattctgggtgaaattcggaaacgatgggaaaatctcgccgctcatacaccgtaaccccaaatgtagaggaacatcggaatgagcattactgcgccgaagagcatccctgcggcgatgtcgcccagtcgatttaatgtttgtcttctcataatcagcctccgaatctgttattacgaaattcaatactgaactcaagccgctttacctgctgttcaagctgattccattcctcttcatagcgaaccattctcagcttgattggctgaggctgacgagaggcttcctcacagagccccataaactgcatcatcagaaattctttcggtgcggctgtctgctgacggctgaccaacgtatttccgatgtactgctcaatgatgacgctgtaggtttctccgagatcaaaaaaacatgggttaatcctcggcaggacggttcagccaatcgacgcaatcagcaaccaagtcctttctttctgcggatgtgtaagcgaaaacgtgatcaacagcatcactgcactcgtttattaagaattctgccatctcccgaatcgtcatcttgcggatacggtcgatgttgcgctccggcaggctacggatgactttgatttcatcccagccctcatcgatcctcggctcacacagctcccgactcatgcgcttgatgacctcttccggaaccggcatatcacggtcggtgttctgtgacagcgcctgctccagcgggattgcaaagtaaacgcaaaccgtgtgaccggtcagtcctttaatctcgctcagaaactcggcgcgacgtgtgtgacgaaggtttgttgcgtcatacacaacatcattgccagcggagagcgattcctttacgcgctcatgcaggatagtaaagacctgcttgtgcattttcttgtcgccgccgtctgctccaatctcagcgcggattgcgtcactggagagcacggttgcattcggaatcttgcaggcgtaggtggttttaccggaacccggcacgccgaccatcatgtagaacgtgggtttaatctgcattacgaatatcctcctcgtaacgttcattgagtgtttttactgcggaaatcagctcgttgatcttagcgactacctcgattgagaacatttctgtactcggaacaagcattctttcgagctttttgatatcgatcccgtagacaagatacggtttgttttctttcttgtgttccgctgccgactccggactgatgatcttctccagttctctgcacagctcgttggctttccatgtgtttgttcgacctatctgcagagtttttacaccgccttctgccgtaaacacaagatgagggacatccttcatgtgtcttgcgtagacattcggttcatccatgtatccgtagatttctccgtcgcgaataagaactacttgccagttcgtattattgtctgccatttttatcgctcctttgctgactgttcgttgattttgttaactgctttgaccaactcgtctaccttctgcgcgagcatgcgctcggtcgcgctgagaaaaactccggcgaggttgatcggtttgattgtgtccttttcgtcttctctcagttttttgttgcctacccgagcaaaataattagaaagagaatctcctccgtacacaaatatcgatctaagtgaccctttatccttttctggtgccgttatgctcacttcgattgttttacgttccaatcttacaagaccggcataatcgctgctgtcataaaacctgacaatataaccaacgctgccatcggctaattcgacgtattcacctacatgcaaatccattcttaccgtcatcctcctaacctctcgtttatttggttgactgcttccactaactcattaagtttatcttgaattacaggcagcggtgtagtcgttgaatacgggtcaagcgccactgcctcgattttgtccccacgaaacttatgacagcctatctgtgtaaagattgatgctggcgattcaaacctttggatgtttacaattttgattttgcctttgtcaaacgccggagtgagaattttgatgacaaactgagttataagagaattattgtctactactgcaatgtagccggtttgtccagtcgctaattcgacgtactcgcctttgtgaaagtccactttagttgtcctcctcttcttcggaatctacccaatcaatcggctgctcttcttcaaacatgacctgtgtgagcttcgaaacggtgccagtaaccttgaattcaatgctgctgttctctggattaacccactgagagaacatatttttttcattttgttgacgaatttcttggatgtttgtgatcagttccagcttcggatcgtaaatcgtgcacaattccactccgtcaacaataattttcattgtgttttcgtgttcatttgtttcaaattcagatttcataattcacctcaaaaaacacttactgcggttgccgccagcaggaataagaccagaatggcggcagccagatatacgcttttactcatggaatcagcccttccaaatcattggggagccatcatcgttgacaagaagtgtgagcgttccgcgattgtacataccgttagattgcgtatacatcacacggtttgcagcgttatacacgatgtcataatagggataggaggcgattgttacaaaatgcgcctgcaaactggttggattctcaatcggctgtgaaccgcaggcggtcagtccgagcgccatcattacggcgattaagccaccgagaaaatatttccatttcaagattgttttgacctcactttacgagataaaccttgtgatactgaacgccgagattgctcgcttcggacttgctgccgactgcaatatccaagatcgaacccttgatagccgaccctgtgtcagcgcagtagaagatgccatcgtagccttcaatgcgaatcttggaaccgagaggaatcactcgcggatcaactgcaaccgtgtaccacggcgttaccggcgtaccgagagcggtgatattgccgccttcatcagctgcgcctgtgtagtaggtgcacttaaaggttcccaaaagctgacccttggaattttcctcggcctttttcttttcctcagcaaccgctgcgttgtactgtttggtcaggtcgatgacggtttcgttatgctcattccacatctgttttgcgtaccagatagtgtaatgatgctcttctgcgccgagtgcgcgggcattttctgcgagctgatgcgctgcattgcgctgctggagcgccttatcaagatccttcttgatatctgccgagcttactgctccggcgcttacggtaagtacagtggtaaaacaggcggctgcggccgccgctcgtcgaagtgcgtgcttgttcatattcagtctcctttgttcttcagttggtcgattacgtcttctacgatacggtcatagccgaccatatctccggttgtgtattggaattcgatgccgttttggttcaaggttttcaggatgagctcggcgacaccatcagcttcagcctctgtttggttgcgtcctgccgggttgtattccttcactcgagccagaaagtaattgagattgttgtaggtgttccaaatgttcagcgtgtactgtttgtacgcctctccgtaacatgggtcatttttattaagataaaccagtccgagaagcaatggagaatctgtgataacgacatctacctgatcagcacagcgccgtagtctgtaatgctgttttgctgtgatgtagtcctgtgcggcgagagcggcttcgtttttctcccaagttttgtctttcgcaaactcggttaccagttcagcgttataccccagcattttcaatcttgcgaaaacatacgccgcaccggtagatttaccgcttccggggccgccgaacaaatttacgacaagggttggcattttaatcacctcacattttgtcgagctcgttataaagctcggttcttgggttgtatggtacatattcataagtcattgctgacttaatggcttggatttgtgcctttgctttggctcgttcctgcacaagttcggccagcttcttataaattttgtagccgcggtgcgcaggaagtttcgggttgttgccggcaaagtgatacaggtcaagcatctgtaattcgcagtctttcactttgatggaaaggtcgtcgataaccttttgcaggatatcgctctgagaaactgctgcatttaccgtcggtacaagctgctgtctgactttctcatccactggctcgatacgacagtttttgaattccccgcgagcattcactcggagaaaattcttggccgccgtgtgtgtgaatgcttttgctttagccggatcgaacacaaatgtcggtcttgctttactgtcgatggcgacatatcgctttttctttgaatggtataggacatattctttttctaacactatttcaccggctttctttttcttctgatggagaaggtgagacttgaactcactcctttggggttagaaacgcaatgtgctgaccgttacaccactcccccattttgctgctctcgaccggagttgaaccggtatctccctgctctgctttgagctacgagagcagatcacccgctgacggggcgggcaacccgtttatgaaattgttgacgtctgggcaacgtcgtgccccgcgcggcttggaaaccttggttgggagttcctccaatttgaattattttgtcctgcgcggcggacgtggtcacccatccgaggtttgaactcggaacttatcggttaaaggccgattactctgccagttgagttaatgggtggtttggaggcgttgccgcctcccagcattgaaaggagttaccgacttgcgtcggtggtggaggacttgggattcgaacccgtggtgatcagccacacagcacgccgctgctccgttttcctacacggctcatcctccatgcttattatggattttataaaagctacaccattttcttactgcgttgtctgaaacgccataatgtcggccaagagccaaaaaatttccgtttgttttttctatcatactaattagattttctcttgtcggataattctcccttctcttttcacgtctacattttcggcataatattgatcctttcgaaaccaaaactccgcaatgtttgcagtaattgttaactttttgagtgttgtttctttttctttgatctttttgattttccgatctggtcgcccattctagattagaaacgcaattatgattacgaacgccatccttatgattaacttctggtttagcgcatttattaggtataaatgccatagctaccagtctatgaacttccacgttcttttttatgcaatcacaatacaaccccacatattcatatcctctattagagatataactggaaatgattttgttcgttttcatagatttgacttttccgttatggctaatcaaatatctatccgagtctattcctgatataaacgaaattcttttccacgctgtgaatcttttcatgagaaattacaccttacttatttttttggtgggtcctgcgggactcgaacccgcaaatctttcggttatgagccgaatgcactaaccaattgcgctaaagacccgtgttgcggcgcattccacgccgccgtccgtctttccggattgtcggagagttaaacaatgacccctttcggggtggagcgcctgacggggatcgaacccgcactctcagcttgggaagctgatttgctgccattacaacacaagcgcatatttggcggggctttcgccccgcgaggttatgccgcggacgaatcatcgataaagtcgtgccacattctcagagcctttaccagtcggcggtcaaccgaccgctttgtgattccgaggatttgaccaatttcttcagagcgatagccgacttttcggtaatcgaccacgaccttcagatcactgggaagccgggcgaggaagtccaacaggtcaatgcagaggacgtcatccggcgaattcatcgggcggcgatttctatcggaacatttgatcgcgttatccgcagctttattgtgcttattgatggttctggtgtagggaaccatctccgccatgatgcaggaaattgcataatgggaaaatgtacaatccttattccggtcgtatgtcacggccgctcgccataatccgcattttgtcgcttgttccacatcctcgttgtagagcaaggtcgggtaatatttgcggataacgaaatatctgatcttgtcatgctgctcaaacaagagcagcgctttttgatattggctttcatcaatcatctgcaatccctccgattctggttttctcgcaagggacttatactcattcttccttttgcactgctatgcaatactcattcttccttttagtgtccgtcggtcatgtgttttcccttacactatctactatacaaaaaacgcgattttgggacgcgaattttgaaagttttttcggtttgtatgattgcacaacaaaaggacggctaacattagccgtccttatctatattgcacatattattttagcttttggagcctgttaaactcttgaatcagcgataaaaaacgattttcattggtgacgattccgctccaatttcggcattgctcaaagaaccatgcttttttgctaagctctcctataatctcaccggacatttcctcatactgctctattttgaggaacagataggacttcgccagaaattgcggcacgagagaatgcggcgcttcaaacttctgatagcgatccagtcggtaaacaagattttgaatggccgctgcggtgactggtcgggaagaattgagttgaatcaaccgccctttctccagaggaacaaatcggaaaatgaaaggctccacctctttaatcacgcgagattttgtttttacctgcattctgtcctcgtccatatcgtccgtcgttaattccgcgatttcatcagcggacaaacccaaagagaacatagccaaggcgagagcctttttattattcctgccggaacggaatgggattgaggcgagcacgttgctcatctcttcaaatgaatcaaagaactgtcctgaccatgctccagccggttggccgactgtttcatcaattgtattcagcgtgcttggaacgttgtgctcctgaagaaactccgcatactttcgcacgtcataccgcacgttactcgcagtttccggtctatcccagacggagtttttcagaagctgattccactccgctccagaaaactcttcaaccgatttgccggttgcaaactctatcggtttagatcggtcaaatattcttttgattttgatgcagtcttcgcgctctaacgactgcatatacgcaactctcaatggcttgtaatcgtttttaccgtccatactgcaattcctcgcattcatactgatacggctattataacacaaatacgaggaatttaacaaggctatcagtagtcttcgtcttctccaacgccgaccgtgaaataatacggagactgtcctgctacgcgaaaactgagaaagaaaatgtccggttcggtttcttttgcaaccgcccagagcaggtcaccttcgatgaagacctggcctgtcatcacggctgctaagtacacaccgttttccagtggctcgaccgaatcgcaaatcatttcgattgcggctgtatcgtttttatgatgggaaagttccatctcgaggctgatgaagttcccttcttggagaaaatgattcaaacttctccagtcatcaaagaaaattgtggtcatgactgctcctccattttatcgaacaagtgttcgtatttttcgatatgcttataataccatttttaccttgtctatgcaatggtaagtttttcatgcaaaagaaagaagtcccaatattgggacttctcgcttctgcttcgtttttacttttgcttttctgcggcttctctggccagacgttctgcccggtgagcggcgcggcgctgacggatttcatcgtcaagttttttacgttcgtcgctgttcaagtaggcttcctgctttcgcgcagcctcctcttccttgcgtttcttctccttgtcttcttttacgcgaggatcgatggattcatcaatggggttataaggttcaatgtcgtattccggataatgccagcctctgcctgtcacatcatcacggtgataggcacgatgcactaacctataattgaattcaattccgagctgcgcacacttccactcgaaatattcaatctgcaatccgtggatactggtgttccaataccctgcgagacgcttccagtttgttttgaatcctttattagcgatacgatatctgggccagtcctcatccggatactcaatggctttcgctctgatgtccagatatttttcgaacaaagccatactctccggcgtggcctgatcgggtctgttagcctgttcagcccgctggcgtgcatctgctgtaaacaaagcacccaagccgagaatcaatttgaaaccgggtaacattgcaattcctccttatccgcagaatccttgataaagtcctgagatgactgccgcaatcatcaaccagatgtatattgaataggcatcaccgaacaaaagatacgctatcttttcagaaagggaagttttcacctgtgcgctacagaatttgtgcccaatcataaaagcaataatatcacaggcattatcacattcctcttttgtgataacgcctgcatcacgcagagcttgaaaatctttcatactgcaatgctcccagttgacttctggggcatcctcgaacaacagttcaaatgctctatgataatcaaactcatcgccgaggtcgatgctgttgcgaccctcttccgttaagtaataccaacgctcctctgccgaacctctcttcggtgctttcttattcataaaaattatctccttatcgtaaatctgtcattatcgtaattattcagcgtctttgatatcgtccagtgtgaagccgtagtcgaggttctcgtacagcttgtttttcttttcctcatccagaccgatgtaacgaagcgttacgccgctgtttgtgtgattaaacatggcctgcagatacgccagaatctccggtgactgctgattgtccatgaacagatggtagccgaacgtttttctcatgctgtgcgtgccgagcttatacggcagattcaaatccttgccggcgttgcggaggattcggccgaacgagtgacggctaatgctttcgttctctcccttctggctgaggaacagctgcgtttcttccgtgtggttcgggatggatgcgaccagctcacggtagcacttcatggcgaggtcattcagaacgaccgtgcggtacttgccggttttctgttccttgaggtgataccggccgtccgctgtaatatcgccgatcttggtcttgcaaagatcaacgccacggagaccgacgctgcacccgataagaaacatcagcgcatttcgaagctgatgcttgtcgtagaaatactgtgcaatcttgaggatgtcctctttgttgcggatgggatcgaccgtaccgttcgcgccgaccgttgtacggcgtttgacagaggcttctgctttggcgactttcttctgcgcctgctctgccttctggcggcgttccatttcgtcagccagagcggaggcaaggagcttgtagtcaatcgctgcatatctcgtcatgttctgcaacggctctacgttctcgtcctgataaagtttaattacttccgctgccatattgtgtaatctcctttcattttagcacatctgcacaaaaatgcaacatatgatttcaattagttgtcaattgcgctctgaatgctctcgacgctttcgttcagactctccgatgcggaatcgagaaaatcgatgatctcagaaagtgcttcgcccttctcgctgtcctgcaggttctccggcatgttatcgaacttctcttcctcaccgtccttgatctcatccagttcctcgtggatggtttcgatacggctgatcaggtcgctgagctgcttgcggttcatcttgttcatgtgtcattctccttatgcggttctgttattcttagctgcatcatacaatgctttcattaagtaatctcgttcctctgccgtagggcacgttcttgctgtgaaggtattcagtgccgactggatttgctctacgctgatgttagccaagtgctggctgagagcgtaaccgcttgttagtgtgttatcaacacggacgtgctgacttggagttgctacgagttcatagagcagactggttgtccgcttcactaaggcttcgtcaaaactcctgtaaagaatttcctttgcgctctggttcataacgccgttagccagagccgggactttcgtttctctctctgctctttcagtctgattagacttagtctgattatacttagtctgattagggttcgatttccaaacttctggggtttgaaaatcaaacttcttgggtttgataatcgaactggtctcaaaatcgaactggtctgaactggtttgattatcgaactggtctgtggataaagtagtttcagaatcaaactggtctgtggataaagtggtttgatttccgaccggtttgatttccgaactggtatcagaatcgaactggtctgtggatgagcttgtggataaagtggttcggttttcgaaccggtcgagcaatgccgggtcgagaacatagatgcgattcggcttgccgagcccttgttttgctctgcgaatgagaccccaatcttcgagcgtatccatcagcttgactgcttttgcctttgcacagccaatgctttccatcaccgagtcaattgaaaaatagacatacggcgtgccgttttcatctctccatttattcgcgatagagaggttgaaccggtctacgattaaggcgtacaggagcttggcgtcagcggaaagtgatttgaaacagggcagcttgaccagtgctgccggaaagcgaatgaacggaaagtcgctcactcgattggtattttctttcattttctttgtcctccgagttttttccctatactatctactatacgtctgacccgaaaaaaggacgcggaaaccttttaataatttgtgaacaatttatttggcaaataaccacggcttttcacttctaacctgctgatacgagtaactatttacgctctttaagccgagcgaaaccgccagtccgcaattgaccgcttccatttcatcgtagctgcagcagccgattcgttccatcagacggctcacatcgaccgtcacaacctgctcacagagagcgatagacggaacgtaaccgcgaactcgaatgtgggtcggaagcggacggtgcttctgcgatgtggtcagatacacgatctcaaccacaccggaagcgcgattattggcatcattggaaacaatgatggccggtcgggttttcttctgctcaaagccgactgcgttatcgtcgttcttgatgtaaaaaatgtcgccgcggcgaatgtctctgtaattcataaatattctccttatcgataaatgttgctcttaatgatctgcatacggtgcttttccttatttgcgtcctcggtgatgacaatgatttcatcgggatggatgctggccgaaccaaggtaaacgccgtcttccttgaggtctctaatcctctggtcgataaacacgatgcgcttttcttccgtcgggaagagataagtggcattgtcgccgtcatcgtaggcaaaagtggctgcgaagctcgggttctcttcgtcgaggagctcttctcgagtcatgccgtcgatgatatcgcggtcacacttcggacacggagcaaaacaatggtcgccgatgatttcctcatgaatgagcttgttctcaaaccagattccgcagttatcacaatgagtgaggtcatcgttatcccacatattatcaaaacaagtgtcgcagacaatcctttcatgcttcgtgtcgtcgttgatggtgcgcggctcgggaagctcgcaatcgtcaagcgtgaatggattgccgcattcggtgcatttgaaaatctttttcatgtcgtttcctccaatcggtcggatttgttgttctcattcggtcgttttaatgttcgttgaacacaacctgctcgccgcgcttcagtgtccaacagccggtgtcagtcattgcacactcggcacagttgccgttgcacggctttgcatctgctcttgcggtcgtcgtgccatccttgaagcgaacgtgcgcttcgggcaaagaaaaaggattgaccatttcaaggtcaacccagccggaaagaataagatgtaaattgtcgggaatatgcttgccgtcactcaagacagcgtttacaaaatcatatcgcttggtgaagcacaggatttcgcaatgccgattgcgctcggcgataccgatcatgcggagcagataatccttgctcggaatgtcgccgctgacgtggaaccggaagtaccggttaagcattacggttgcctctacttcacgccagaacgtctcaggattgctctggagcacctcgaggttatgctgataggcgtttcttacggtcggtctcagacgctccagcttggctgcgtaacacttctctttgcatttgcagtcgcggcaggtcttaatggccggcaagctgacggacgggattgctcccatcttggaattgcccgggctgatcttaatattggtgttgatagtcatgatgtatacactcctttttactgctggttgattacttcatggaatgctgcggatgcggcatcgttccacgccatgccgttgtcttccttctcgcgtttgaggtatgccatacggttcatggtgtcaatcgaaatatcgcggatatggtcgtagagcagatcgtcttcgacctcgatagtatttttgatatcttcaatatcgttttcgtgctggatggtttcgaaaaccttagatgttacatggtttttcaatgttacgggcgaaatattccattggaatttatgaccgtcactcgaaatggaatcatcatcccaagacacttcatcatcgaactcgtcgttcgagccgaagaatgtctcatggtcgtctctgttaaaaccggagatgatatcgtcaatctcctgattgacaaattcctttgcttcgtcgtaagtaagaaaaatgccatcggtaccaaaatattgttctccgcagtcgtaataactgcggagatgagatactgcgaatacaatcataatgaatcctccttatcttgcgattgcggtgttgtgcaggcgctggtcgggcttgaaagaacgtccgtgttctacaccctgatcgcggtacttattcgcccaggcaccggcggttcttgcatgagacgtgctcgttttcatgctgagattaccgtaggcatcctgcacgtccttcggcgtcatcatgaccagtccccattcctgatgctcggcgtcctgcttctgatattcctgatccagaccggcaacaaagccgtcgccgtaagcgttgcaggcaaggcggatatcggttgtgctgtagccctgccactttctcgtgtgatgaatggtgcgctgttccctcttgacacagtcgattgcgtagcggaggatgcgctcggcgatttcaatatcgctttcaagacccatcaaaataatcgtgagtgccttgctacgcggcggcttgcggcagtaattcttgcagcaataatgcttggcaatcacgtcgctcagcttgtaaatccagaagtcggtcatcgtcgtacacttgatatcggcaagaaccttggtcacaaccttttcttttttgccggtacactcttctggacggagcttgtgctgtaccatgagggcgcgagccttgagcagagcggctttcgcttcgttttcgttcggagattcagcgagtgcgaggagctttgcgattctttccttgatgttgttattcatgatgtatacctcctgtttggatataaaaagcaggagctgctggctcctgcttgtgtcattattttatacggattcatttttaataggtcgttcttccggtacataaaccggaatcacttgcagcgtatttcttccagagctttttgaaaagtcttacgacaccgtcaaactcgtccttttccttagcaatatctgcaaggtcatatgcgcttgcttcatctggaactgaccaaatccacgtcatgtatgcagtttcatcgttcatgcacattacgagatggtgcattgcagtcagcgtgtcgtagcgttccttttctgccggcgtgagattgagctcttcctgagctttctgtaatgcaatgtaattcataattacctcctaaatcatcgtttcatccttacaaaatatattctcctgtttctaacgattgtggtattaactgtacataatctggatgacttacaaattttacatatttcaatatgtattcctctacattgttaaattcctcttcgtccatttcattcgcatctttcaacccaagtttgaatttttgtgagacattatttactgcatcttcaatcggataatattttttactcatgtaaatttcctccgttcttctcaatgaaactcttgtttaatacgctcttctatagtaaatattggggcatagagacacgttataaatgtaagaaccacagcgaaccagtagagcgtctttgccgtagtatttctttttcatcccaaagatgctcccagatttatcgaaattcgggaatgattcaatgttgacctgccatccttctgacactggaagatatcttactcttggcattttgtatttctcctttcaaatacctgcttacgtttcaatagtgatcgcgaacgccttttcgccgtcgagatcaacgtcgtccatcgttacatcagcgcctaacctcgtcagcacgtcgcggagctgcttcttttgcatctccttctgctcatcagttccgctgaatccccagactgttttgaaatacattactatgtacctctccttgaatatcaaattctttgatcaaacgctggcgtgtactgaaaagcaacatcatacatcgacttaccagtaatctgatctctgaatgtgctgacgaacaggcttcgtgtgaggccctcttctttgaaccattcgtcaatcactcgcttggtcagcggagtgaggaacacatagagatcggattcatgatggtacatttcctttcgcggataacctgcggcttcgagcttttccatcaaggtcataatgtttcatcctttcaaccatttagtctgcaaatccaagaagatatgcaacgcccttgctgtgatgctcatcgaaccaatgccagatatcttccttgtcggttcctttgggccagatgtagtaaggttcgtcaagttcttctgtctctgggtcgatgggaacatcagcaagattgtcccagagttcttccacaactacatccctaaaagctctgtcactggggagcttcgaaaacctcaattcggttacctctccatcgttttcagataatacaatgtcaacgtggaggctcgggacatagaatttccacgattttggcgctggatctacataccactcacactcgcattcgaaacctccgtagtatttttcgaaatattcatctaacgtcatgtatcttcacctcaaatactcgttttagatgatgtcaacataccaataaccggtatattcatcttcttctccgttacgcttatcttcttccggatcatagtagccggtagagagcatcacatcttcaccttgtttcctgtacagctcttcaatccggtctgccatcagctcggcgaacatctcggttgcacaaaggatttctccttcgatgtctgaccagtaagccgcattccggttgtcgcccattcccttgcgaatgatttcaaaccattccggcatcgggtcgttttccatatcacggaagcagcgtccattaccccagtcgcaaaacgctctcggattatctgcgctgtggacgcattcatcacacaagagaattcgttcaccgcaatgcttgcaggttgtgcgccagccgtcttccggtgcccagttgggcaccgtgttttctcccatgcagtgaggacaaacctcaactgcttcgtggcggtattcagtcatgtttaacgcctctttcttaccagctgctcacataatagagcatttcgttgtcaaaatccgtggttgcgagaacattttcaaggacttcgacagtgtgtcggaggtcatcgaagtaatactcgtcatactcgtaacttccgaagaaaaatccttcttgaaccggcaaccatcttttcgcttccgaaacaggatttgatgaattgagcactcgtttgcaggtgttcaacagctcttcgataacgcctttcgtgcattcctcgtggtaatcgcagtcatcctcgccgtcctgaacgttgttgacgaaccatctgtgaatctggttcgcttttctccagtaggcaacattctggataatgtcactatgcggatatacatggtttgtatcccaacttgcaaaccgctcgacatagtacggacgaagcacttccatgactttttccgaaggaagatcatcttggcttgcgccgcaccattcttcaaaagaagaagtcctatattcgttcggccgtttacagtagccgaaccattcttcagtagcacaaacctgctgaattgttacgctgtccagtcgaggagctttcattaagtacatatccaatcccatatttattcccctttctttgcttttctgacaagattgtctgtcaggtaattgttgatgttgttttcgtaatcgggagcgccccatttatctacgaacggcaggttgcttacgtaatgaccgttcatttttgtgtttgccggagcaaagccgataacggtatgcttttcaaccttttcggtgaagtcctgaatgaaaacctcatcatagaggttgagcgttttcgggtctaccagatcagccgtgatgaattccgtgccgagctgctcctgtttcggctggcactcatcaattgcgcagagcatttcggtgaggtcgtagccctcgtgacattcatcctctggcttgatcacatcgggattccaatgcttcacgattttccaatccttaatttcgtaaacgccattatcaagataaaactctcttacaagttcggacgtcataacggtcgtgccgctcatgttttcaataccgaccgacaagccgccgccgaaataattgccgattacctgtgcgagtcgtgccgtgccgtatgcaggattactctcggggctgcggtaacccttcagcttgcaatactgagtaaaggcgagtaccgaatcgtacccgccgttccagtgaacatatacgccgatgttagtaccgacgcctttgatgattgctcgatttcccatgatatactctccttttcttagttgctctgcggcttcttctgcacgatatagccgcgcttgtccaattcctcgatcatctgctcgtctgtataagactcgaagttgtagtcaatcatggcggattcttcaacccattcctgctcatctgggtcgaaacggaatcgccaagcacaaccatcttcgccggtataatttgcttcaccatctgcaacatacggtgctaaggtgtcaagaaactcaatggtttcgtcttcgtggtacttatcgctttcgtagaaatccacactatctttgtcgatgttccaatcaaagcggacatcgagcgcgtccagtttgtcctttaattctgtaatatccgcatctcttttaagagttgcgaaaccgctgccatttgcacaatatcccatgattttctcctttcaaattcacattttaatcagttcgcggtactcgaccgcccatgcattgttcgtgaagaactcgcggatttcatattttgctcgattgcttgcgacccaatcgagcattttctggtgctgctggtcactttcttctggactgtcgaacagccatgttttcactttccagtagcgggtcattatgtatcacctcaatccgtagttacgaaatagtaggtcagttcgtcacccttaaggttttcctgtgcgtactgggcggcacgctcccagagggtgttatacagtctggccagcggttcattgtgttcgtagtgctgccagatcttccagttcagcaccatgacaagctcggtcaggtacttataatcggttttccattcttgaaaggcgcggttgtaagtgtcgcaaatcgcgtcgataccgaaattatctgcgatgctaaagtcctgccagaaggtggtgaacggcttgtagccgcacagttcttcgatgttccagcgagggagtttcgaagtgttgtccatttgttatgcctcctcaatgtaggtttgcttgctcttaatccttaacgatatttattggattgaacggttcgagatctttacagtaaagagctaatctgtttatactaaacagtttcttaccgatactcaaaacttcatccacattgtcggaatgatactcatttccgcacaagttatcatgctcgtcatacgctctcaaagtgtatttcgcttcgacaggtgattctttttcaatcctgtaatatacttcattgatagctttatcccaaccatcttcgaacgtgtcaggctttgctccgcatccgccgagttcgcgaagaatttcaaggacgcggtcacgcttgatgtaagcactcatccttcatcacctccccaacagtaatcagagataatgatgtccggaacaatttcctgctcgtcccagatttccagataatcgtaaggctcccgggcatcactcaggagcaaatccttttcaaccagacggataagctcctttgccgcgcgttcgatttcatcgaaactgtcagaatgatacagttcgccgtacatatcgttgtcaatgtcgtatgccatgagggcgaaacgcatattttttttgtccgacatttcgtggacaccttcctttctaatttctgttttcatgttagtcgtcctcctgctccaatgctgttgcaagacgatccagcatttctccaatttcttctgcgtcgtctaaaagagaacgcaaatcccacgggatactgttgtctccatttaacttagcgttgaaccactcaaccgcgtgtttgtccgggtcgaaatacaaccagcgatcgcggacatctccagtaatatttttgggatttacttcgaatgagaaatcttcaccaagcggagaatactgactgagtgtgatatattcatcatcttcgtcctcgtcgatttcccaaccgaggtcttcacagattttgcgctgcttgtctgtcatgattcatgcctccttaataagcaactcttgtggtgaatttcggattatggagcattttcgcggccactttcgtagcccagtcttcaatccgcagatatttatggccgtttgttgtaatcacatctgcggtgcctgtgaagtatcggaggccgtcgctgccggtttcgaagatgatgattgcgtcatcttcagctacgagctcctgcaatccttcgataaacgctgcatactcggagaagataccatcctcgtttgtcgggcaaacgcctcgaatttggccgcagcagccgaatccatatcgagttacgccgtctttatcaagactttcgaacactttaatctcggctttggtgctgtacacagtggacataaacgccttgaatttatccgcatcttttacgcgaaagtaatttgtgcggattgcgcaagtgtaatttgccatggttgattctcctttcaaatcttccagccgtacacttcggcgattttatcaccgagacgctgagtggtacgagtgatatctgctctggttacggttccgcgaagaaccttttccagaaagttttcctttcgagtgtcgcttacgtccggcttgaatactcgatacaggtaatggttggttccatcatgatgaatagcttcacagcacagatcgccgcggccgtcgagataccacgttgcgtagtcggtatctgtatacaggcaatctttaatcgaatgtccgtggatttctttgtaaccggacttacgaccgtcccagaggccaaggtcaccgagcacgatgatttcctcggaaacaggaatgtcaaggttcatgcgctcatcgtcaagatgctcgttattcaattcatacatcaggtcgatgcgcttatcttcatccagatcgggatactcatcgtcaaagaaatccttccaatcttcataatcgagattgtaattgctccagattactttctttttcatatgtattcgctccttttaagcgttcgtccgaacgtttgttcggcaattttggtaaaaaagaagagcttgcaggttattgcaagctcttacatgtattcgatatttacttgtctttgtgcggaaaatcggaaaaatcggttaggtttccgaataaacctgcccaaaatcccatctcggaagggtctccgatattttctttgtagtattcgtaggcttcatccgtgataggatagtcaatcatcttttcggtttcaggatcatagaacttggtcgttttcatttgttctcacctttcgatctgtcgtaagcggctgcagccttcatcatttcgtcgcgctcttcatcgccccacgctcctgctttgagatgatagagcatgtctcgagcattggatgaccctcgatggtcaatccaccacttcgccgaagtctttccttgcagataatgctcgatgaagaaaccctttgagcgatcatccagaaaagagaaatcagtaaacttgccgcggatgtcgaaagcccatgcaatttgtttctcggttccttccagagtaggaaggccgtcggaattctccaaagcgcgttcgtggtcttcttttttcttcattttccgctcacaatcacggcaaaccgtaatgtttttcgctgcccattcttcaaaactggcggcttcttcactattgcggcgcttgacttttatctcaaaatcattcccgcagaccgcacagtgacattgtgctttggccatcaacaacacttatcacctctctttgcttgccattataacattgtcaaggtacgataacaaggactttcgcccttgttaaatgacggttttgtggttaccagcgtcgagaatcttcagtacagcgctgaatcatttgctccataagcacggttgtgctttcaccgtcgattttccactggcggagcgtgttgcacatatcctgtgcaagatgtgctctctctcgggtgtaatcgccctctgcagtggcaagtgcttcgtcccactcgccgttcggatcgttgcgagctgcccaacggattacgtcggccaacgtgatgttgtctggcttaggaacgattcgcatattgtcgcgccagttctcatcgtttacgtcgatgaggaatttgccgcgattttctcctcgctggcgggtgtaatgcagtacgtttttgtctgcttcatctacatagagaatacagagcggaaattcgtcccacttcttttcttccgtgtacagcgtatcgcggattacatcacgcttcgcaatcagctcctcgtcatactcgaactcatcgccgtaattaaaatatccgagctcggaaaaaacgcgatagccgcccagatcaggagcaacaacgattgcatcaaagtcaccgttaagaccgtttgcaaacgccagaatgctttctttggtgtacggaataatccgattaccgagatacttaacgcgattcttgttgcaatcgtccggatctccggtgatgtaaaagcaatcagtgataaacccgttatagacaccgtttgttttggtgtcacagcaagacatctcaagatacactgagcgaccatctaccagatggaatgcagtgcgaatgcggcagttgccgattgtttccttgctgcgctcggcgccagaccaaccggcaccctcgaatactaatgttttcatactgctgcttcctccttctcgatgatgaatccttcctgcggttcgatgatgaaccgctcagtgtcttcgatggttgctttggggccgccaaagcaccacgacattccgattccgtaatcgggagcgccggtttccttcgcggctgcaatgaattcattctggactgctttggataccagaatgcgagtgcaatcgtatctcagtgcggacacgtctttgtaccccattacctttgcgaagttgtcgaacagtgcgttcatggagaacgtatggcactgttcctgcgtgagttcatatttcattatgtattgcctcgctttcttaatttatgttggctgcgggctttgtggatgaacccgcgagaaccttacactaattactatacaaatcgccccgttttgggacgttgtaattattggaaattatgcgatggtggaattgctgtcggtgaattcagctttcatttgttccgaaatgtcgtagattacccagtcgagcatcttctttgtgaccggaattttatccaactttttacgccggaacaccgagcaaactgtctccgctttgatgaaagttgaattagatccgcagatatcacgaggccctgcaaagtaatacttatcggatatgtttgcaaccgcagtgcggttatatccgcaaatcttacagatgtcgattgttctgtaatacacttcaccgtcaaccagagttgcaagaacagttccgtattcgtcatgcttgaattgcttcatcggcggataaattttcttttgcaatggcttgccgcaaagtgtcggaacgatttcctcgtcaatccatcgctcaaactcgaaaagcaactcgattttgcgacgatttataagcgagtggacgtcatactgtgacaaataagtcacagaatcaaccgatccattcgactttggagcgcgaattactttcttaaatgggcataattccgcaacgcttgcgggatttttataacccagtgcagaaagaatcgaaagtgctttgaaatacggcttaccaccaatctttgtggcttcgattgttccgaagtttgggtggtaaaacgtttcaatcttactgttcgtcagaagcggattattttttgtcccggtttcaggcactggttggagcgtggtttcagttcgctgcggagctgcaggctgttcaatttcctgcgaactgctctcgagttcgttctgggcaagctcgattgcgtgacccaaaacatcgaggattcttttcgtgctgttgtcattgttcattatgtactctcctttcaggctgcacggctgtgtttgccgcggtaacttgtctccgcttgataacgcttccagagcgttttagttgtgttccatgcgtcccctacggcgaatgtgccgaagacgacagctccaagaaaattattttcaccggttgcaaccgtagcgacggttgccatgatagcgagcaccgcaaacattgcggtagaagagtagtttttcatgggatttagactcctttttcgattttgggtataaaaaatgcaccctcgtcgggtgcggtgagcatttgatttattccggaacattcataatcggaatccatgtgatagcctcattcatgatagagtaagctacgcttgcgacagggtcttcggtttccatgtcggtgaaatcgctgccgttcgcaatccatcttgcgagcgtttcgatttcgtttgctccgaaggtggtttcgttcacccagtcgagcattttgctgtactgttcattgtccatgcatgtgcagtaatcatgggcaatgcacatattgcggacaccgtagctgtccagaaagatttcgattttcatttcgttttcgctccttttcagtttcgttttgctctggtttcagagcatttcgagggcggtttcgattacgtttgcttccgtttcggaaacatacgcttcgaagtatacgccggtaaaattttcttcacggataccgcttacgttgtaagtaatatccatttcttttactcgcggacggattttgttccactccgctgtggaaaggaatacgccgccccaggtgcggggattggttgcgatagctgtcatatgtattatccctttcgatttattgcgaatggttacattttgtgatataatctggttgtcaccaactttgatccgctccggccagtgatataaatctttacatactgaaagtatgtgtgcggcattacgatacatagccgcagatttttataatgaaatggaggggtcactgtggagcagaacatcttcgtgctttgctttgcgctgatcgtactggcaatcaagtgcggttgatgacagcaccggcaggcttacgcttgtcggtgttttcttttgtgacaaccagattatcaccgcctttcggcgtggatgagggctttaaggatgaaccctcgagaaccttccggcaggaatcattttcaaattacttacctttcggtttcctgttctccgccctgcggtgcagattgcaagacctgaaaggctcggccttttctattgttgggcacaggctttttcccatgctccgcaatcataggcatcccctctttcgtttttattgctgatcatcagatgtgagcgattgctcgacagccgatgatctgaccggattcgttgcggactgcatcgtccgtgataaacacgtcgttgcggtcgcggcatgcctgcgcagtcagcgcagacacaagataaattgtttccggctgcgggtcgggcaagccggttacagcgccatacgagcactgattgaccgggattccgtttacttcggaaaccctttcgcgggtctgagcggctcttgcgattgttccgctcggctccaccgttgcgaggacggaattgtcctcgcgcaggaagttgattgcgtgcggtgtcaggttgataatggtcatggtagtttctcctctcgtttgtttgcgttttgttttcgtttccggtcggttttgttttcgtttccggccggtttcggtttcgtttcttatgcgttccagacggttacgatctggagaacctcatcgtccagaatcgttgccgtgttcatggtgtcgaaggtcacggcgagttttacgctgcgcggtgcaacgtagtcctcgatatcccagaggttgccgtcttcggtttcgatagtcgtgattgcgtaatcacggtcatcggtcgggtacgaaaccgaatagatttcgccggcgattgtgcgggtttccggtttgttttcaatcggatttgctaccggtgcagttgcggtcgaagtggttgcgagggctgcgagaatcattgcgattgtggttttaatcatggtgaaaaaacttcctttctattgcggttttgggcatgaaaaaagcacccggattgggtgcttgtgcgaatggatttattttgttttcttgctgaggtcgagaccgtattgcgcttcgagggcttctgttatgaatgcattcacggattttccgcgaaggcttgcttctctttgcaaaatctcacgtttccctttgggaacttgataaactacacgttcatagtttgcctttttgtatgcttcactactcacagtatcaccgcctaaaattatggtataggcgtattatatcacgcttgtgcggatttttcaaattgtgcagacggtgatttattctaaaaaagggtgcactttccctgcggtctttttgcttgtgttttcaggcgtgccggtttattgcgacacgcctgtttttgctatgtattgcatactattttcgtatactttcggattatgaaaaagatctggcggttgtgtttacttggtggtcttagcggtggtcttgcgtgcctttgctacgattgcacggttcttgcgtgcggtcttggcgtccggcttggcagtgataacggaattcttgcgtgcgcaggctacggacttctcggttgctacggattccttcttgccttcttctaccttgccggaaagcgcgttcggcgtgccggttgccttcttggcgattgcgtcctcggccttcttctctgcattggtctgcttgggcgcggataccttcttttcctttacgccggtgtctactgcgaaggacttttcttcaatgcgcattgcgataacgttctggatcaggccgaggatagacttatctcgatcaatcttcatgacgccgttcacgttgcgcttggcattgcccgcagaggtcttgatgaagtgcacgcttgccttagtcgggtgtaccttggtatccttgccaagaatcatcatgaagattgcgtcaagctgagaatacaatgccttgtcatcatgcgcggtgaagtcgatgatacgcgcttcgcccttcttgttcgtgccgtaacgcagacgcgacacctttgcagggcggttttcatcggacagcatatcgccgtgatacagggcgatattatcagcgaacctctgaacatattcaaagtattcagcgtcatgtgcgagggtcttttccggcattttttccttcttcatgaaggcgtcaatagcggttaacggaatacgaacgtttacttctacggtgcgcaggccgttatcgtcatcctttacgcgctgtgccgtgataaactgcttgcgcaggaatttctcagccgtgccctttgcagactcagcgataaagtcggcgcgagtcttggtgtttgcttcttttaccttgtcagtgtagacagccttcaccttctctttctgtgcaggcttggtgtctgcgctgttgtacagggtttcgagtgcggacagagaaagtgcggacagggtctttgcgctgaagtttgcgatcttggtagtagtgttgttcttagtcataataaatacctctttctgttgtgtatatggtttttctgtgtcgggacttgtgtcctttagaaagcgcacaagtcgtagcttgtgcgcttgtaaaagatacaaaaatatcgtactgttgcgcttttaggtttttgtgtccgccgattcctaaaggggtttacaccccgctttcgtagtgcccccgccccaagtgccactttgggcgcggttcgtgcataggctttcatccatgcacgggaaaagcgtgtttttcaaaccggacttagctgtttttacagagcgggacaggggcaggcgttaagtccttcctgtcgtacttccggtatagcacggactaccagagacgctactttttccgcgacactacttaaccattttttccgcttttccgcgcttgacaggttttctttgcggctttaccagatgatagctacaccgtacagtcaccttacaggggttttcacggtgctttgcaaatgagcattgcaacagtggaacgtccccgcgcgacttttcatataaaaagagggttaaggttttcgcattgctactttatccgcgcggtgcattccgcgcctgaaaagtagctttcgcgcctgttaagttttcaaggtgctttgggcggtgtttccgatctgcgttccgcttggcactgtgtgcccgtactgtgtacgctgtggttcacatgtctttcgcactgtccgcgctatacggttctcaccgtacccgcgcccgtcgtaatgcacgctatacacgttctgataccgcgccgactttcggcgtgcacgttcggggtgctatacccgacgtctgtccgcggaatgctgtccgcgggggctacgactattcgcaaggtggacaccgttcggactgtccgcgcgtccctcgacgctgtccggcggtcttggggtgtacccccttggagtgtctccattatagcgcgggtgtacccccttgtcaaccccttttttgaaaaaatttttcgagctgtttttttcaaagataatgaaaacgcacgcgcgcgtagtggttcgcaaaacaggcaaaaacaggcgaaaacatgggttttgagcgcggaaaagttttttgaaaaaatcagaaaaagcgcgcaaaaaagattttttccgtcgtgctgcccgacagcaccgcgccccgacagcaccgcgccccgacagcgtacaccagaagcgacgtagtatcgaagactatatggtatagagttatccacagggaaaagtggttatccacagagttttccacaagatagacaccgtgtctattttttagtgcaaagataggtgtcttgacacctcaaaaaatgggcctgatctaaaaatcgacttttcgagtatactataaaacagcgctccggcacttttcgccggtgtaaatgcctcttttttatcaaagggggcgtattttacacttttacagatatgttaccagtttctgtcagggtagttgcctcatctcactctaccccatattttccccctctttccccgaactttcgctctcctttccctccctttcctccccttcaaaccccgtttcctcaatttcgtgcgatgttcccgagttttcgccatctctcctttcccgaacactcgaaaaaggtgcattcctacaatctgctgtaaccgtcagctcgagtatagctagccaggaagctctactgaagctctacgcatgctctgccgcagctccatcatgcatctgtcacgcaagtctacagctgccatgcaatcctgtatctaacctatcatctccttatctcccgccagaagggaatactgcctatagcactatgtagcactacacactcttgctctactatgactgttctctgctatataaattagccgccgcgatctctaaagcccacccttatagtttccatgcgtttccacatattgcctacaatgcctcgtattcgcctcagaatgctctgtactggcttttcgtattctcgtggtataatttcccattcgtatgtcaaaaacgattacagctcaattctgccaccaaaacagaaatggctcttcaacggcagctacatctccccgtctctttctattacgtctgcgtattcactcattaaaaacagccggccaaagtttttaatggtcggctttatctatttctgtattactaaggtctaagccagccagaagagcatgcttcagctggctattttcccattgagcaacatgcacaaaagaattctcaatctttatgcatctttttctttaactctgcgtcccaaaaacgccttttttgtatagtagttaatagaagcaaaaaaatccaatcaccccgcaaaggaggcgtccagatggcaaagcgacctgctattcacacgacatagaagtacccaaagttccgcagctacgatggccgcagcggattcgatttcatccctatccctgtagtccctaatctcaagtcgatctctccggctggaaaaatcctgtactctctcatgctctacagaatgcagttgtcaaaaagccgcccagaatggattgacgaggatggcgagccattcatctattactctctcaaagaggtcatgcgcgatatctcttgtggagagaagaaggcgctgcagctgtttaaggagcttgaagaagcacacctgattcgtcggcgtagccaatgtcagttctctaccccgcgcatttatataccgaccaatcatccagacgaagcgtgacgctcattccgagtgattccatttctctctttctctggctggcattttcaaaatttcgctcagcccaacctatgtatttatgattaagtattttgattatgtatttatgattagtgtatttatgattagggtttgatttggaaggacgacgagtttgatttggaaggacgataagtttgatttggaaggacggcgggtttgatttggaaggacgcgagttcgatttggaaggacgggaagcaacatgggtaaatcccagccagaaaaaacgcagttggccgaactgaccctgcgtgacatagccaacgccggggctgatttacatgagttcgccgccgttgttcccttcacactggagggcaatggacagcgggcttatatcccgacctcggtgctgcggtattacaaccccaaggtgaaacttgagccaaaggatatccgttatctcgacccggacttcttcgaagcacgcattagagatatcggagccaatccaaccgcgaagccttatcagcgagatgtttcaacagccactccggcttatggctctttcgtctggctgcgcgttccgctcgagggcgggagctattatgacgttacaccgaccgaggcgcaaaaactgatgatgctcctgactactacggacaagcacctgatgatcgcggctgatgtgtatccgccggacatcgtgaactatttgtcaaaagtgtttcagctgaccgcgccagttgttcaaggtatgctgcggatgttcaggcaaaaaggtttcatctggcagaatgaccgcggcgagtggttgtttaaccaagacctgttccgcaggggtgagattacacgacgcgagtccacgaaagcagagcagaacggtttcaggtatgtgaggatgtatttctcctctatcgcacagatgtacagaactgagtccatgaatctggggctgaaatacctgctcccgatgctcccttatctgcataaggacttcaacgtgttttgtctgaacccgcttcaggatgatccgtttctggtagctcctcttaccgccgcacggctttgcgccgctggcggctatgagcgaaacggatatggagagctgactagcctctattacaaccaagtcatccgaaccagtaaaggaacggagacgatcatgacccggctgaaggaaccgttccacggtttgccggtcggaagcattatgttaaacccccgcgtattttacaccggcaacaaagtgatagccgccgagcttgaacctctgtttctggtgcgaaggcgcggcaagtataaaaaacgacgcaaggcaacagaaaactaatattacaaggagtgcaagaattatgaacgcaaacaccaactatgtaaccaaggaattcctcttcaacgaccagcaggtacgcacggttgtccgtgacggcgagccgtggtttgtaggcaaggatgtagcagacattcttaagtatacaaatacggcaaaggcaatcagagatcatgttgatgccgaagataagctgacagaacgtttcgttctggcaggtcagaaccgtaatgtgattgtcatcaacgagtctggtctttacagcctcatcgttgcaagcaagctgccgaccgctaaggatttcaagcgttgggtgacttccgaggttctgcccactatccgcaagcacggcgcttatatggatatggatgtcattgagaagacgctgactaacccagactttatcatccagctggctaccacgctgaaagaagagaaacagcgccgaatggaagctgaagctaagatcgccgccgatgagcacaaggttgatttctacaatgcggtcggcaacacttccgctactctgaccatcgagcgttttgcgaaactcgtaactgagaaactcggcatccagactggccgcaaccgcatgttccagtggctccgcaagaatggatatctgcaggctaacaacatgccgtatcagcgttatatcaataacggctggttcaagacctacgaggtcgtaaaggctggtcatgcctttaccgttccttccatcaccggcaagggtcagcagaagctgttcgagaagttcgcggctgaggcttgaaaagcaaggagagcgaggcggccgcttttgccgccagaaaaccaataaaaggagaaaaccacatgaagaaaaaccactgcatccacgatgactgcgagtattgctcgcgctacaactcctgcaacctaacagcagatgatgtctgcgggtatgcagttgtataggtagatcttgagccaagtgaatattggctcgaaatgagttactaccaagcgggcgaccctgacgcgcacttgtctatgcgtgatcgtctccgcgccgagtacagtggcgaggtgactgaatgacgaatgccgtatacattccaagtgtggacggcaaggatgtctacctcgcaaaccactatgaccgtccaaccgagatcggatacaacatccggtcttcggacggcgggtttaatctgaagcgattcagaaacacgttggattactcgctcgacctgctcaagctgagagacgtctacgagcgggtataccgccgcaggaatttctcttttgagttgggcggcaaggaatacacacaccgtgttatcaacgtgacggcgcattacgcagtcaaggcattcaaccgtatccgcaagacgctgtacatcaaaaacggctggcgatacgatgagattgccgagaacatggatgactgtgtgtatgttgtcgacggcgagctgattgccatccagtgcgacacgaatgttcagaaccccctccccccttccgtactcggcaagtatttctatctggaagacggccagtacaaagcaaagattaacattgccaccgaggttagtgttgctgaaatccgcgaggagctttacgaaaagggcttctattgtgacggcatccattatgttcgttacaagcggtcggccggttcctctcgtgtcggcaaatgtttgtacatcgacgaacgcctctaccctgctatgcacaagtgggagatgtgcggcattaaagtgcaaccgggacaggcgattgatctcgctgctctggaaagctatatcgcgctgacggcaagctctattgtggacacgctggaggttcggccggagaactttttggtaatcgatgattttgagagcacgtttacggatgacgttatcgcgaccagagtgcgtgaagacggtcatctggtgtctggccccgagcacgtcgagatcacgaacagcatctgggacggtcagtctttgatggacaagtccctgtttggccccaagtacgagcagtacggcatgctgctgcttcgaaaccgattttttaagtcctgctgcttcaacgcaaacattcagcagttccttgctgaccacgggattacgaaaatcgagcagctgaacggattcacgttggcgaagtctatcgaggacatcaagctgatcactacgccgtccagcattaagtatttgaagtttggccggctgcgcgagtggctgaagcgtactgatcctatgttcggcgtagtaaagcatgagaagaagacgcacttctttgacggacgtatggtgtctactcattatcagttgctgaatactctgcagatgtcgcaggaagaggtggatgagttcctcgagccgtccatcgagtacatgcgacagctgaagaacaatccggcggttatgcgctatcatctgaaacagcagtcggcggccagtgagatgaaatctcccctgctgaccagaaacgacattatcttccgtctgttgggtatcaacgacagattcgcacagacgcagatgtatgccgagttccgagacgggctgattcgttcgtatcagaacaacatccgtcgcggtcatgttttggtcaacggcaattactcaactctggtaggcaatccattggaaatgctgaaggcgtccatcggacagttcgacggcgagtcgtctattccggtcggtcatgtgatgtcgctgcgctttgatgacggtcagcgcctgctggggtcacgcagtccgcatgtgtgtcagggtaatatcttgctggcggacaacctgtatgtgcctgaagtgcgccgatatatgaacttaacagaagaaatcgtatgcttgaattctatcggcgaaaatattttacaaagattgtcaggcgctgattttgactcggacacatgtatgttgactgacgatccaatgctgattaaagcggctgagaagaattactccctcttcaaagttccgacttcgttggttgagtctaaaaaaaccaagcgtgcttataccagtgcccagcagacagacctcgacatcaaaactagcgaaaatatgatcggcgagattatcaacctttctcaggagcttaacagtctgctttgggataagctcaacagcggcgcggcttttgaggatgtggctgagatttactatgatacgtctatgctagatgtcatgagcggcctggaaattgataaagcaaaaaaagagttcgtggtaaacaaccgcgacgagtacaagcgcctgaaagctaagtatgagcgccgtgacgacaagggtcgcgcgattaaaccgaacttcttcgggacgctggctcgccgcaaaggatactatgatagtgaaaagaaagcctacctgtttcacaagaccacgatggactacgttcagcacacaatcaaccgctgccgattctggcgaggttcttataaggccgacaagccatttagctatgtgatcgacccggttatggtcggtacggctggggcgcgttatgaattggcgcggaagttcattgatgccgctcgcgataatcgtcagagaattgcttgtattttcgcaagtggtgaaggtgtcttcaatatcggagacgttgtggagccggagttgaatttcctgcggatcaaagaagaagtggctgcagctaagcaggaactcatcaattttgtagccaagtataagtgcaacccggcgactatgtatgtaattctgcgtgatttagagaaagaagaaaataaagatatccgaactacgctattcgatgctcttttcggaactgcaaattcttcgtttttcgaaatgatcgagacgagtcgcgaaccaattaaaattgcaacagagtgtctgactggtagtcttacactctacggatatacgtttgaagcctatgaatctaagagaagagagtttgaggaattatacgaagcagagaaggaagcgcgacgcagagaacgtcatcggccacatacaatgcaggagatcgcaaggatttttcgagaacgcaacggctgataaaatctgcagaaaagtaacgaaaatcatgataagaatgcaataaaatgaagggctcttttcccgaaaactcggggattgagtcctttcttttttagatacaacaatggatagagaagcgatttttcgctacttttccgtatcattttttaaggagacataacgatttgatccgaatttccaaggctgaaagagccaccatctacaaactttatccagagcttcgtgttccgcgtaccgccaccggcaagtattggctgtgcgaagaagagaagtacctccgcgttattccacataacaaggacgccgctgcactgcttgacgttatcgaccgtcgccgcgcacgactggctgcccttaccgaggaggctaatgcgtgaagactgactggctcagaaaagaagatgagagcgagtacgcctacatttaccgtatcggtaacatcaaagagcagattggctcttggcaggacgtagctgacctgttgaactatcagcttggctaccagtacaccgagagcaagtaccgcaaggactatgcggcattctgcaaactctttgaagccaaccgcgataagctgactgataacagtgctcagcttcacgagattgaacagcgcgagcttgagctccgcaaggagcagcgcaagttctacgaccagcgtcaggcactgacccgcgtagtcaacgcaaaggcacgcgaagaaagcctgcacgagtgtattatccgctcagctgagcagctcaatatgagcaagccactggttccgctgtctcgagcgggagaagtccatcgcctcgggacggaagccctgcttgtcctgaccgactggcactatggcatggtatgcgacaatccgttcaatagctataacccagaggtatgcgctcagcgtgtccgccgcctaattgatgagacggtagagcgtttgctggtgcatcaggttaccgacctgcatattcatctgttgggcgattttgctcatggagcaattcatcctacagttcgactggaatcagtcgagaacacctgcgaccagctgatgcgcgtctcggaaattcttgccgaggcaattcatgagatttctgcggctgtagaccgtgtagatgtgtttgctacttacggcaatcatatgcgaaccgtacagaacaagaaagaaagcatccacgccgacaatatggagaagatcatcccttggtggctggcaacacgtctcaaggatgacgataccatcaacgtctgcccgatgtgcgaggagttcatcacagacttcatcggcggcaagaccgttgtttctacacacggcgatctggacacggttcgagactttggcgtgacggcgaatatgctgctgtcacgcgaccttggcactccggtggatattgccatcatgggtgacaagcaccatgcagaatcgcttgaccgattcggtgtggacagcatgatcgcgccggctctttgcggttcggacaatcatgcacacggcaagcgactttatgctaagccgagccagctcctgatgactttcgaacaggactatggccgcgatgccgtgtattatctcaaactggaggaaaattaaagcatggcaagagccaagaagaaagaagataagaacacgctgtattacgctgcgctgtactcgaagcactcagaactgtatgagatggcttacgaagacagcaagaaggttgtaaacagcgtactggacagtatcaagcagcttctcaaggaatgtgaggtgctctcgctgccggacttcggtaaatttgaaaaccatgagcgtaagtcttaccagatggtagacaacttcccgggctccgatggcaagaagcgtattgtgccgaccaagcacacggtacgattcaccgctttcccgaagctaaacgaagcctccgaccagttctacgctacgatgcaggaggcggaaggtggtgagggttaatggcattagtgcctaagattcccaccatccccaaaaaagaagacaagctcacacccgcagtaaagccgcaccagattaagcgatgcgtctgctgcgggacggaatattcccgcgcgaccgatttttacaacgcaccgaacacaatgctgtattgcaacaacagcggccgacttcctgtctgccgcggctgtattgatgagctgttcgaccgctatcagaaaatgttcgatgcagacacggcgattcggcgtatctgcatgaagtttgatctatactactcccctactctggttgaagcatccaaagagatgggagcatataaaagccgtatggcggcttatattgcaaagctgaacctcaacgcttacgacggaaagacctacgattcgacgattcgtgaggaacagaacttggctttgcagacctatgaagataccgaaacccctactcagcagacagatttccaagtaaccaaggaactgatgaatgagtgggggcttaactttaccgccacagagtatgaattcctgcagaatgagtatgaggactggctggcgaagtgtgtcgttaaaggcaaatcacagcaatctctggttcgcgagctctgtattatcaagctgcagcagaacaagatgctgttggacggcaaggtggacgtctatcagaaattgaccgacacctaccagaaaacactcgaccgtgctgcgctgacgcctaaaatcgtcgaagcaaaggatcgagagtcggaaatcccgctcggaaagatgattaagcgattcgaggaccacgacccgattccggaaccgcttccagagtggaaggatgtagacggtatcatccgtctcatcagcatttacttcctcggccatttgtgccatatgcttggcatcaagaaccgacacgccaagatgtacgaggacgaaatgaataaatatcgcgttgatgaccctgacttggaggatctcgatgatgaggacgtctttgacgccattatgaatcgcgctatggagggtgttgatcttctggcagaaaaggaagccggagaagagaacggcggtgatgcctgatggatgccaccaaagctgaaaaaattgaacgaggtatgtgcaagtgggttagtttctatcgagctaatccacatcgttttgctcaggattatctcggcatgaaatggctggcgatgttccagtgcattctactggacttaatctgtctgaacacctatgtgatgattatcgcttctcgcggtatgggtaagtccatgatcgtggcggcggctatttgtgttcggtgcattttgtatcccggtctggaagtaactgtcgcggccggcgtccgaagtcagtcaacgaacctattgaacaagatagtcgaaaagttcatgcctgactcacccaatctaacgaacgagattgaagattacaaggtgacgcccagcgaggcgtacatcaaattcaagaatggctccgtggtcaaagttgtaacagcgcgtgattcttcacgttctgcgcgtacaaactggatgattgcggacgaattcgtgcagattccgaaggatattattgataaggtgctcagaaagttcaaagctggcgagcgtactccgggcttttacagttttccaaagtataagaactacccaaaggaacgtaacacggagacctatatcagttcggcatacttcaaatggcattacagctgggcgaaatttaaggcttattttaagtcgatgatcaagagcgagccgtatatcgtgtgcggtttcccttatcagttgcctgtttctgcaggatattatccgatggaacagattcgagaagagatgcaggaagatgatttcaacgagataagctggagcatggaaatgtgctcagaattttatggtgagtccgaacgtgcattcttctcttttacagacctaaactctgtacggcgcatcacgcgcccaatctatccacggcctatgtatgcggcacttggcgatcccaagttgaagtacccaaacaaagagccgggggaaattcgcctgctgagctgcgatatcgcaacttccggcggcgcgaagaacgacgcaacagcgatcaccctgttgcagctcctgcctaacaactctggacagtatatccgaaatgagtgttacatggagaccattgatggtggtcatggtcaagaccaagcaatccgcatccgtcagctttatgatgatttagatgtggattatgtcgtagttgataccaatggtggcgacgcccctccttctggcgacagttggagtgcagcgcggaagaaaacgggaaccctgagacgggaatccgactggaaggcttcgagtaaagacgaagtcacaggcaacgcatacgaggtgatctcgccaatttggcgaactataatcctcgcacgagtccgcgccatctcacgcagatgaaaagatatgctcatcttacgggaaataaaccgtaagtttctggataaaaagccagaaagaaaaggtgaggtcggaatatcaatctatgatcaacttgttcaagacctttacgacgagacccgaggagtcgagtaccgagcttggtcttgtgttaacgatgaaaacatggccgctcgaagccgaaatcctaacgcaccgcgtatcatatattcgataaaagcgagcgctagtaagaactcagagatggcagtttcccttcgagactgtatcaaacgaggcaaactacgcctgctcatcaacgaaattgacggcgttgagttgctcgaaaagagtaaggcttaccgcaagctctctgttgaggaacaggttgcataccagcatccgtactaccagactaccgcctttgtaaacgagacgatcaacctcgaatatgagctgtccggtcagaacatcagggtgtacgaagtatccggtatgcgtaaagaccgttactcgagtctggcttatgccaattacattgcatccgaactggagcgcgacttgcgccgacggtcaacggatgaattcaaatacgcgccacggtgcgtttcgaccgtggaattttaatttggaggtgacatcatggctgaaaatccaaagccgctgattgatgaggcggaagatggtgcaactatcgtcacctcatttgccgaccgcgagactgcagagcgatacaggcacgctgttgcgacgtatgacccgcagaaccgcatgtacagcgcatatctcaatgatggcgcttcagcaagcacgctgactaccagcacgatttcctctctgggtgaaggagcacagtccaatctgtccagtgtccagagtatcaatgctattatccgcaagtacatcaacattgatgacattgttggtatggtcgtacagtccatccagaacaacatcaacacggatatccggctgtcgtaccgcaacttcaacggtgcccgtaacaagacaaaaacgctggaaaaggcacaggctatcctgaacgatttcaactctcaggtgcgcgtcgagcagtttatccgagaagcgattgtcacggcatatatcgaaggcaactttgcggccgtgcttcgcaacaacacggagaactggcagattgattggctcccgttggacatcatcgagaactccggctatgagagcaatggcaatccggttcttctggtgggcatcgaaaacctgaagtctgcactgcagaagacaatgctcaagaacaaacagcgcaagcctctgttcttcaacgacacgcaggaagaggttgaagcaaccttcccgaaagaggtcggtgaagcgatgaaggctaaggagacctatgctattcttgacaacaactatacttacatggttcgcgtcaacaattttggcaagaaatatggtgtctcccctatcttccgcgcaatgtcttctgttttgatgttggagacttaccgcaacgcagatgagaccacggcgaaaagtaaggctaagaaaatcatccatcaagtgatgaatgagaaatgtcttggtcccagtgctgaccgccgttgctttgaagaacaggcgtataaccatgacaacctgatgcaggcgtggaaagccagtacagttgttgttaccactggcccatccgttaaggagatcaagtatgtagagccggaggtaaacgaaacctctgcagaaacggtgaacttgtaccgtaacaaggttctttcgtctctgggtgtcgcttttctggcggcagacaagtcccagacggcttctacggccaacatcaacctgtcacagctgctcaagtgcatcaactctatctctgagcaggtagagcgtatgctggagcatttctatcgtcaggttctgtcaattaacggcattggtgccgagtatatcccgagtgtaaagattatcgactccgaactgctcgatatggatatgcgtatggagcttagcaagctgctgtacagtacgtttgctgtcagccgcgaaacttccctcggcatggtcggcatcgaccttgaggatgaacgggttaagcgcgaaaaggaagaggctgacggtctcagcgatatcttcctgccgtatgctacctcgtataattctgacggcaatgctgacggtgagagcgaccccggccgaccggctgattccaatgacccggacaaacagggatacgacgaaacctacaacgacacacgggagtaagccatgaaaaaaaagctgaaactggtttgcccgcattgcaagcgggactactttctattatgcaaatcaggcatctgcaaaccagcagatgccttttttgaagaagaaaacgctgaactgatcgcacaaaagctgaaagagcgcggtctggagtttggcgtgacgaaggaggtgaacgagaccgatgaataaagaaaagacatttctgaccagtagcacgattgaactgagtgaggacgaagagaattctcagtttcttacgcttgtcaaccgcatctgctactacgatgagccaaatctgaactcggttctgcttccctccgatactgctgaagagtgcgctcagtcgctgattgacatgccggtatatgcaaaatgccgcacgaacgcagacggcgagccgacattcggtagtcacgaagttgcactggatgcagatggagagctgttcttcgacacgactccgattggcgttcatacagccgttgaaatcaaggatgatacggtggacgtaaacggaaaactggagacactcccctgcctttttgcaactcaaaagatctggaagcgcaacaaaaacgctgtagcggctataaaacggctgtttgccgaaggtaaactccacaattcgtgggagattgccagctatgaatacagctttgcagatggcgtaaagaccatcacaggctatgaatttgagggcaacactttcctcggatatgaatttgccgaccctgcttatggcaaggacgcgaaggttgtttctttgtcacagaccgatgagctgatggttgctgaagcgttgagccgcgacctgatcgaccaaaaatcgagtaaggaggacgaaactttgaagaagaataagacttctgcacaggttgagccgcaggttgacccgcaggcaaccgagcctgctgttgagcctgcacaggcagctcctgttgagccgaccgttgagccggcacaggctgagccgcagaatatcgagcccgctcaggctgagcctgctgacccgcagcccgcagaaccggaaaccgcttctgagccgcagccagaagagcctgcagaaccgcagccggaagagccgcagggcgagccggtagttgcttccctgaccgactgggatatccagcgaaagattgaccagggcgcacgcggccttattgacggctggtactgggtggcttatctgttcccggaagagcacaaggcacttctgcgcgtagaaggcaacgatgagctgtcctatgtgcaggtatcttacgttgtaaacgacgacgataccgttaccgtatctgacccggttgacgtaaagctgtctgtttccgtatcggaaatcaacagcaaggtcgctgaactgacggatacgattgcttctctcaaccagaaggtgaatgacctgacggctgaggttgagatgctgactccgtaccgtgaagctgcccagaaggcagagcacgatgcggctgaggcaaagctccgcgcttatgcagagaattccaagcagttcaccgaagaagaactgcagagcgaggaaatgacgaagattttcagcgaactggatgagtccgcgctgaagatgatgattgctgaccgtgtggtttccgcacaggcgcagcagattcaggcaactgtatctgcaccgcaggttcagctgtccaatacttccaacctgacggtcaatgaaccgtccgcagacggcgtatctctgatgcgtgcgttcctgcgccactaaaatcaaaagaaaaggagaaattgacatgattcgagagcttgaaactgtacagggcaagcccgttgagctgcttctgacttccgcagttgttaagaagggcgcaccggtagacgttgactctgaggaccagaccgtaaaggcaactgcagacggtcttggcaccaagctgtgcgacgtaaacgcaaagtacgagggcatctactctatcgttgagccgaccgatggcgagtttgaggaggctgcggctggcgagcgcgttcgcgttatccagaccctgccgggtgagatgtatgctacttccgagctggacaccgagaccctgcaggctggcgacaagctgcaggctaagggtggcaagttcgtaaaggcaactgctggtcagtacgcttacgagtaccgcggcatctactctgatccgaccggtatcaagatgggcaagatcgcgcgtgtagaggtttctaccgtagcataagccctgttaaccaactacatttgaggagtcttgtactcctcttttctattttttgaagaaaggaagatacacatgaacactgaaatcagtgcaattatggatcagtctggccgtgttctggactgggcaaatgctgtaaagtattccccggctgagctgtctgctgaggacaaggaaatctccgcagttaccgacgcttgggtaaaggagctgggcaagaccggctatgacaaggatcacgagctgtccgctctgattaccaagaccttcactccggagaccgtttctgctccgtccgagctgatcgatatgctgttcgacaccgattccatcggcgagtttgatgattaccgtgtaaccgttgacccgaagaacaccatcgaggtatatgacgcaatcgccggcggcaacgtaccgcgttctttcattgaccacaaggttctgaagcctactttctgctctctgcaggctgagacctctctgaagctggaggacatccgtcgcggcggctacaagaccgtagctaatctgatcgcctacatcaacgaggcgtttgagttggagcgcgttgctcgcatcatcaacgttatcgacaaggctctggctgatggcgacaacgtattcaacgaggctgaggctgttccgtctgatacggtttctcgcaatctggcaacctacctgatggatgttgctgagaatggtgaaaccccggctatctttggtcagaacaagtacattgttggcctgaccaaactgccgtctgcagtaaccggtttgtccaacgaggtgaagaaccagtacaacaagctcggcaagtttgaactgtacgctggctgccgtctgttcggtctgtctggtgtgaagaagctggctaacggcaacttcattattcctgacaagcgcctgttcgctgctgctggcaaaatcggtaaggtcatcactcgtggcgagacccgcactctgcaggagaccgacatcaacaacgagcagattcacatcaaggtttctggctactcgttcggttctgtcatcactgacatttccaaggcagcaaaggtagtttacgctaagtaatccaccttggtgttcgggcggacaatagtccgcccaaaaataaatctaaggagactaaatcttgaattacaaagcagataccccagtaaaggtatttaatcacagcatcagttctatcaatcttcccggtcagttccgagagtattatttggaaggcagccgtggggtcccaacggttctgacgatgccattctctgatgtggaatacatcaactcgcgcacaccggtgttccgcaatggtcgtgttcagtttgatgagaatgagcgagatggtatttatcatgcgctttatctcgacaactggaaggacacggttctcttcgatgaagagatcgaccgcatcattcgtgaaaacgatatggatgcagcggcgcggttcgtgaagattgccgatgttgcggagattcatcgtgttcgcagtcatatggttgctctgcagaacgatgatggtgcggaaatctccaatcgcatgattgatattatcaaccagcgttacgatgagatcaaccgtggcgtccgcaactctgagatcaatcttggcaaggcgaaggaacgcgcaaaacaagacgaagacccgcgcattacggcgatgatggaacagatggctgcacttcaggcacagctggcggctatgcagactgcgcctgcacccgcaccgaagaagcagaccactcgcaagaaggctactccggctgcaaagaccgacgctgagtaaacacgaggaggtgtacgcccaatgtccactccttgtgaatctgtctacgatgtttttttcgacctgatcgaagaagatcgtgactttttcaactactatgaagcgactgatgaagagagttacatgcttgcccttcagcgagcgaaagctctgctccgcgacgccgcaatcagaatgcagatggaatgcgatgctgaaatcgacttcactgatacctatacggaaggcgaagggcgcaaacaaaaggagtttttcactgctgacttaactcccttcgaaatcgaccttctcgccaacctgatgtatgagggctatctgaagcgagatgtttccaagctccgtgcattccagcaccaatatacgccgagcgaccttcaggtattctcccctgctaatgaccgaaagacctttatggctatgtacaatacggtcgtagaggagaacaaggttaagctcgaccgttatgctcgcagagaccgaacgaccggtaagcagcgcagtattgactatacctcctacgaaacggaggaaagttgatgaacgcgctggaaaaaaaccgttggatttgtttcggcaaagaagccacttacgccaaagactcgcgtatcgctgctcttcaaaaggactttgcaaatcatttcaaagattcgattgattatcagccggaagcgaaggtcaatggaaaacaacaagaactaattgtggcaaaaaacaagagcgttaccaacacccgccgtatttacgcctatccgggcgaaaccttttatgcgggcgatgtggtagatgcacttaatgccaagtggctgatcacagaagttgatcagaacaaagaagtatacaccaagggcattatgcagctctgtaaccgcgagcttatctggcagaatcgccataccggcgagattcttcgtcgttgggttacggccgaaaagccgtattactccaatctggatgaggcaaagccgctcacagtttccagccgtgagtacaagattcaggttacgttcgacgaagagacctctcttatagacatagacaagcgattcatgctcgaaatcatcggcgaaagcccaaaaacatacaaggttactgctgtcgataccatcactgcgcgttcttaccagagcggcgagattcgtggattcttggtactcaacgtaacacaagacctttacaaccccaagaccgaccgcaaggacttgcttctttgcgattatgttgaaccggcgcaaatgccagacccaacaccctcccctgccgacgacggaaaaattacgttcacctataatggcaacgcaacgattcgtcaaggcggttcagctaagaagtttaccgcgcatctgtatgacagtgcggacaatgagattcttgatgctgagtttgagtggagtattgctgtggacggcgtactaatggacaaattcacgttgacaccgagcggcgcttttgctcgtctggcggctatggattttgtcgaattgcaaggcgtagtggttcagcttatcgctaagcatggcgagattgaaggaaatctggatgtggaggtggtttcgtgagaaacggggacaagcagtccgaagtaacgaagctcaagcgagagattatcaagctgctgtattcaaatcctgaaatcattgaaattctggacaacgagcaggttgaccctgactgcccagataccgctgaatgggtttgtattttcccgtatgtaaagctggctaatattcaggaggaggttggcactttcatcggtgtgaccattgactccaatggcccgctggagaacgaccgattcaagcagctgcttgtaacggtgacggccttttgcccgattaccaatatgaaggtagaaggacagaaaggtacgcgcaccgatattctcgccggagatatttccgaaacgctcaactggaaccgcagcctcggcatgttccgtttgaaactcgtaaatgagcaggagggcgttatgtctgctcagcaatactatttcagaacattgcagtttaccgcaattcgcggcaatgacctgaagaatgggcaggccaatattcattgaatgacctgaaaatgtaccgaggcgaccctttggtcatcaatgacttaatccaagtgcggcagccgacactcggagagattgcagattttggcgaagagcgttattttcagatgctttccgctatctgtggttcgccgagcgactttatggtggcacttgatgacatgggtatccgatacgaggagatcacggactttcaactgttcttgatgctcactcgcaacttaacaccagatgatacccgtattttactcggagatttagacttgtctgcttatgagccgcagctcaacccgcaagacggtcagcttcgcttatacaatcctaaaacacaatccgtcgttgacaatgcggtctatcaacagatcacgtcattcattcgtcaaatgcactcaatgacgaagaagatcgtcaagacggtaaccgagcatgacagagaatatatgctggccaaggagagacgtgctgcaaagtacgctcgccgccacccgcactttgaatctgtcctgttccctttgatttccgcactttgcaaccatgaggggttcaaatacaaccccgacacggtttgggatgtgcggatttttgtgttttatgacagcttaaagcggacacagaaaatcaccgaagcaagacaactgacggccggattgtatgccggtacgttggataaaaagagcatcagcgatgacgctctgaactggttaggaaacctgaattaaggtttccttttctaactcaaactaaagaaaggaagagacacactatgaatatggagaatttccttctggagtccttcgatctggcgtctatctacgacatcaccactggcgagttgtacgcactgtgcgaccagattaaggatggttctctggagaacaccgttgattccagcgatgttaccggcaagatgggcatgctgctcgcatccctcgaccgtaacaaggctgcaacgattacgtggaacaacgcattcctcgtagctggtctgctggctgctcaggctggtactgacattgaagaggcatctgaggacaacaagattcaggtcccgaacttcgagcgcgttgagctggacaccgacaccaccgctaagctgtcctacgttccggtaggcgttgagggcgctgaggttaagcgcatctggctggttgcaagcgatggcacgcagggtgctgagtacactgttgttgctgagaccccggttaagggcaagtccttcaccgtaaacgctgcagagaagaccatcaccttcgcagctgatgacctgaagaagggttccgagatctacgttgcttacgaccacgagatcaccgagggccgcaagatttccaacattgcagacaacttctctaagaatgcacgcattctggttgactgcaccgttgctgagaagtgcgacgagaacatcaagcaccatgcaatcctcgagattccgaaggctaagatcgatggcaactacactctggatatcggtgacgagccggctgttcatgcgttcagcgctaagactctgaccgacgtatgcgccaaggacaagaccctctggaacatctatctggtagcctaagttatctgattcatcgggaggctttcgagcctccctttttatacagagatgtggccaagcggtaaggcagcggaatttgactccgccaagagaggtaacgctctcgctcgttggttcgaatccaaccatctctgccacatgcgagtgtaggctaattgggaaactgggaatctccaaaattctccgatcttcgttcgactcgaagcactcgtgccacattaaataagaaaggaaactattatggctgaatatctgaacgcagtctgcaaagtctgcggcaaaaagtatcaccattgcgagaagtgtgaacagatcggcagctggcgtgctgtagcatgctcgcccgaatgctggaacatctgggtagacactgttcgcgcacgcaaagccgctgaagctgcggcacaggaaccggtcgtagaagctcccgttatcgaggagactccgaccatcaactatgaggattcgcgtcctgctgaggatgtatatgacgcggatgtaagtgtatcaaccgaggaatgaccgtttttgtcctcggtttctttacatttcgcaaataaaacgaaaatttttttgaacggaggcgaacgcgaatggctttaaccgattacaaaccgtttcagacggtaaagatcaacagctacacacagcttgacatcgtgccgcacagctcgattgaggctgtggcttttgaaaaatgcgccgacccgaaagagacactcggcagttactattccagtaaggaaaagaagccgcagatcatgattaacggcggtctctttaatatgtccaccgggcacaacgttatgtcctttgtctgcgacggaaaggaacagaactaccagaacggctttacaggtatgggtgtgcttggcagcgacccgacgaaactggtatacggaactgacaaggcgcggaagtggaaatatttcatgaccgcataccctatgctcgttattaacggcaaggcaaacaccgtttacggcaatgcttctaacctcaactacttaaccttgcgctcggctgtgggtgttcgtgaggatggaacgcttctcatcctgacggtagacaaaccgggcatgacgtttgctgagatggcgaaaatcttcgttgaatacgatgctcagtatgcgatgaacctcgatggcggaggttctgtccgcaagatgcacgagaacaaggttgtgaatgctccgattgaaaaccgaccggtggacaacgtgttctgtgtatatctgaaggaagacccgctcgcgaagttggctgaccagaacgaaattgcaaactgggcacgaccttatgttgagcagacggttgtatccggcgttatgcagggagacgcaaacggggagttccgaccaaaggctgctgtaacccgagaggaactcgcagcggtcattgcgcgtgtattggataaggttgagtgaatccaatgcgcgtattaagttttgaccaatcaaccttgataaccggctgggctgttttcgatgacggcgaatatgttcgtcacggaatgatcgacttgcacagccagaaagacggcagtatacgctttacggagatgtgttttgctatccgtgatgtcatcacaaaatacaagcccgatcaagtggttgtcgaggatgttatgtacatgaagtcggcgcaggcgcttattgttcttgcccgactgcagggtgtcattctgggatactgtcacatttttcaggttcccgtaacgatttacctgcctacccagtggcgcaaggtgctcggctttaagcaagggcgcgtcactcgcgaaaatctgaaacaacaggctatcgacctgattcgcgaaacctataacctgtccgtggagacggacgaagctgacgcgctttgcatcgcgctggctcatcttaaaattctggaggaacaaaaaaatgtccaagaagactgatattatggcggctctgactccgtatgtagagtctgtaaccaagaatctcactatcggtgagaccattattccaatcaagattaagccgctgattaccccgaagatgcgtgcgactattgtaaatgaggtcggccagcatattgatgacggtgacggccgcaattttggtctggttgactgggctttccgctccgctgtcgtgaagatttgcactgacctgcatatctcactggatggtggctttgaagctgctctgttgtataagaccgatatctatactctgattgcaaaggttatcggcgaggaaaagctggctgagctggaagaggcttgttacaagcagattaacgccgcgattgataccgagttggtactgatgcaggcaatgacccagtccaacccgtttgaccgcatcgcagacgcggcgacagacctgatgagcggtctgaagaatgtgattaccggcattgatgttgatactgcgaaggcactgctgtccggcacactggatgattccgcagcggacaacctcgtctacggccttttcggaaaggagggtgaagatgggacgccagacacagatgaacaaactgacctctccggagctgacgaagcagataaatccggagaacattcagttgatgaatgattttctggagtatcttcgttctctgaaacgcagcgaaggcacaattaaaggatacaagagcgacctgcttatcgtattcacttatgtgctccagcactgcgggaacaagtcgtttattgatttgaaaaagcgagagattgtatctctccagaactggctaatcaatgagaacggcaactcccctgcccgtgtgcgccgtgtaaaagcggcgctttcttctctctcgaactatatcgagaacattcttgacgatgaatacgaggacttccgtccgattatccgcaagattgagaacccgcagaatacgccagtccgtgagaagagcgtcttctccaccgaggagatggaggtaattctgcagaagctgactgaggcgggcaagtttcagattgcctgtgctctcgctctggcggtctacagcggtcgccgtaaggctgaactgactcgattcaaagtagactggtttaagcctgaaaacgtggtttttgactatttttactgcactcccgagaaggttttgactaagggtgcaaagatgatcgactgctacgttataaaatcaggatttgacccgtacctgaaacgctggttacagcagcgtaaagacctcagcattaacagcgagtggctgttcgtgaccaaaaccgataagggttacgagcaggcttcggctgaaactttgaacagttgggcgcagacgattgaccgattcacggttaagccgttctattggcactcgatgcggcatcttttcgtgtccaatctggtgcgcgacggtatgtctgagagcgacattaccgatgtagtcggctgggcgaacagcgcgatggtacaggtttataacgatgtgccggccagcgaacgactgagtaagttctttgagaacaaacgcgccgcggaggcagaagaagccgaaaagtgattggaggcgacttatgaagacttttaagagtattgcagctctggaagctgccgccaaggcttcggcaagaaaaacactgaactatcaagtgaaagaccttgtggagaagaaaatacgagaaaaggcacaagaagtagtttatgatagctactcgcctactcagtatgttcgtcgaggcggtttgggtacagtttttgcggaaattcccggaacgtacacactccgtatcttcgatattaactcagctaacaccccgcaaaggagcggtaatccgccaggtcccggatatttcgcccagatgattaacgatactggtgcgccaaacgtattcaataacgccgactatccgtggatgcatccgcgtcgcttctatgatgaaactgtcaaagctcttgacggttccagcgagcttatttctgttgctcgcgccggctttttagccaacatttgagggattccctcacactaatgagcattcgctcaaattttctaaaatttaaggagaaaccaaatggaactttttctggagaatatcgcaaaagacgcaatggacccgtcaacctatcagtattttaagggtttgcaggatcgccgcatcgtattcaacgatgaggttgacgaccgtattgtcgagagcgtcatacttcccttactggagatggacaacgacggcagtggcaagccaattacgattgtactgaacacctgcggtggctcgctgtttgacggcatgcctctttgtgatattattgacaatctcaagactccgacaaccattttggtgaccggccacgcctattcgatgggcggctattttctgatggccggatacagcaacccaaacgtaaccaagaagtgcttcaagcactccactgccctgctgcacggcggttccagttatatggaaggcacgagctcgtcggtaaaggatacgtttaagtttacggaacgcttcgaacagcgtcttcgcgattacacactctctcattccaagatcacggaggatgaatacgagcgcatggaacgctacgagtggtacatggactcggacgatatgctcaagtatggtcttgtggatgaggtgctgtgatgaagaaattctatgacacttgtgctctgctgaacgtcggtgaacgtgcgttcgcggagcctttttacatctctatggtgacgttgcgtgagctggagaatatcaagaccagccgcagcaaggatgccgaggtcaagcataaggctcgcaaggtgacccgactactggacagtcacccagagatgtatacggtagcaaactacgccacggtgattccgagcacttctattgctctgcatgacggttctccggattacctaatctgctacgatgcggcacagacccgcgcggcagagccgattgtattcgtgacggatgacctctcctgtcgctgtattgcgcgaggattgtatcacatggaagtagcatcttctgatgtagaggatgatatctataccggatatgttcagttcgcgggcacttccgacgaaatcaaccagtatatggagcagctcgacacctctaccctgttcccgaatcagtatctgttgctgacggacacggagaccggtaagacgagcgaaatgcgattcgacggcgagaagtttgttgaactgcgtctgccgcactccggctatttgaagggaaagaattcgcttcagcgttgtgcgcttgatctgctgatgaaccgcgacattgacattgtggcaattctcggcacttacggcagcggtaagtctttcttgaccacccagatggggttgtatcatgtgctcgaaaagggaaaccagagcaaactggtgggaatccgtgaacctgccggtgaaggcgctccggtcggttttttgaagggtacgcttgaagacaagacgcgcaacttcttcctgccgattgagcagcagctgaagggcggcgagtttgagcttgaagctcttcgtcagcgcggccagcttgatacgaatatcccatattatatgaagggcacgacctacaacgacacgattatgcttgtggacgaggcggaagacttgtctgaagcacagattcgacttgtaggaactcgtctcggccagaacagccgtatcttcttgagcggcgattatggtcagtcactggtggacagaactgcgaacaatccactggtaaagatgtgtaatgaactgcgcggcgagaagtccttcgggtgcatttaccttgatgaggatgtaaggagcagcgcaagtaaactgttcgctgagctgttcaaataaagtagacaggcgaaaaggaaagatgtataatgtctccagaaataaagattggcggagatattatgtatcaacaaaatacgaaagtcgaaatggctaacagtaagaataatcgcagacgagttaatcgttttaatcgaagaaaaataatcgttggcagccattctcgattggctatcccgctattatattcagacagaagcgggaaaaggcgcaagcctaccgacgaataatcaggagtgtttatgaacatcgaatatcttatcaataatctcgaccagataatgatttatttcatcccggcgactgtttttatggttgcctatcgtttgacggctcgatattcagctcccagagaacttttctctgcaaatactgttatctggagttatgttttaacggttggattgcgttggttttggcctaatatcagcataccgattatcatagcggtgtcgtttgctttagggttctttggcggaattgtccgcaactccggatttgttgcttttctgctcgataaagttttctacaagtcgttagatgaagatgtatggtatgcgatttctgatttcaaaaaaggtacaactttgcgtgtatatcttgacgattcagatatttcttaccaaggatatttcaccgaagatcataagagtgaggatggacatcgttggattgtcttgactaactataaaaaatttgtcggtaatgaatcgcatacagatgaaccgttgtttgactacaaagaagataatacacgaaaaattgtattagacaccacgaagatttcgcgggctgaaatcaaatatccaaagaacagttctaaaatttaatacgagtctgaagcaccacataaatgtggtgcttcttttattttagccgcgcctttccgcggctttttgctataaggaaggtgaatttatggctgatttaggcgttactgtcgaacttatccctaattttgacaaactcgaaagcgccctcagtaactacaaggagtttccgattcaggttgatgctgcagctctgcagaaaagtatcagttcagcaatcaaaaacgcttcctcaaccaagctgaaagtaaacgttgatactgcaaatatcactgctcagattaaaaaggctatctcggcggctggaactggaacgactggctccggcaaagctaagtcttctgcggcttcgacccgctcctctaccataaagagtagctcgtctaagagttccccatcgggcaaaacagatgcagagaaggctgcggaacggcagttgcgcacaatggagcgtcaggcaaccggcttgagacagacgatgtcgtatctgaagaacatgccgagtcctatcgattcaaaggctatctcggcggctgaaaccgcgatgaagaagtttgagtcaacgaccaagggaactgtagaaagcgttaacgcgctgaaagaggcacagcaggcgaccaatattgcgttctctcgcaataatttgaaggctgcagaaaaggccgagcgatctatgttggatgttcagcagattcgctctaagtttggtcagttgaaaaaaggccagattctggacgagcaaagtgttaaacagctggatagtttgctcggaaagtacgaggccgaaaaaaactttacgccggctaagtatgatttggagaagcaaattaaaagtgcttggactactgcatatcgaaagaattctaatgctgctattgagagtgctatggctcagggcaaaaactatatcaaccagatgcaggcactgcaagccaaaggcattctgaaggattatgactggactgcttttaagaacgcgaaggatgtttttgagaacgcggcggccggcactcatgaattggagcagggtctaaatggtctccgttccgcatgggctgatgcaagtgctcaggctgaattgtttaacgcacagcagactgctaccgttcgatctcagagatcgcaggaacatctggcgaacatttatcgtcaggccagcgagacactcaagaacaatccgaaggcggcgggcagctacttacagggcgaactgcagaacatcatgaaccgagcaagaaatccgggcgagaatgacagtgttgaggggttgcaaagagatctcgcggcggttcgctccagtatggaagaactcgggtttacgtctgaaactgccgggcagaagctgactcgtctgtttaaggatcactttaacacggctattgcgatggcaggactgcacttattgcagaacggcttacagcagacgcttcagaatgttatcgacgttgacacggcgatgacagacctgaaaaaggtttcggaaggctcaagtcaggattacgctaattatcttgacagcgctggtgaacgcgcgaagagtctcggcgcttcgattacggatgtaattggagcaacatctgagtttagccgactcggatttaatttggaggatgcctccaatcttggcgactgggcgaccaaatatatgaacgtgtcggagtacacgaacattgaggacgcggcacagtcgcttgtttctactctgcagggcttccatcttgctgctgatgatgttggaagcgttgtagaccgtttcaatgaggtcgggaacaactacgccgtgtcctcacgaggtcttggtgaggctttacagcgttccgcggcggctctgtacgcaggcggtaactctctcgatgagagtttgggcctcgtaacagcggcaaacgaagtggttcaggacccagacacagtaggaacatgggctaaaacccttagtatgtacctccgtgccgctaaagctgatgctaaagaggccggaatcgaaacggatggtatggcaaactctgtgagcgagcttcgcgaaaccatcaaaactttaactcacgacaaagttgacattatggccgacaaagcaggcactcaatttaagagtacaacgcagattatgcgcgaaattgccgacgtttatgatcaacttagtgacgtagatcaggcagaccaatattgcctgtgcgtacagaaatgtgcgtaaataacacatctaaaaccagtaaaacctaaagccttgccaccacaatgcggatgaaataagctggcatgacgggaacgaaagtaaaacaacggtaaggattgcataaggtcaaaagcctaagtgcagtgacaatggtagcttggtcgcgaagcctcgaatagaggtgtgtcaaacgatcattcccatgtagggctgcgtaagcagcaacagaagtacggcgcaaacaaaggcgtgggtgagaaccccttaaatggaaacggtgtggtcgtcgccgaaaggcacgattaagaaatgatctaaacttctgcggaaacgcagagatgctgttttagacagcttgcgggagttgtgaccccgtggaatatactgagcattgctcgaaaagatttcgggtattcacttgcccggttgtacagtaatgtgcaataacaacatatttaattgcaggtaccccctaaagccgcacaccacaataagcgcgaaagcagtttatgacggtgcgaaagcaggaacaacgtgcggattgcatacggtcaaaagcctaagtgcagtaacaatgggtgatcatgcagccaagctcctatcggtctcatgacacggagaaggttcacagactatccctcggctctttatgagcaacaggagtacggcgcaagcaaaggcgtgggtgaaaatcccttaaatggaaaaggtatgccccttggtttcaagggtgaagaaatagtcgggtctcatgtgaaagcatgaggttgtaaatacaacataaggctttgcaacccttataaacacaaacgaagagaatggcgaatacaacttcagcgctcatccagaactggtcgaccgttgaggatgtcatcaaatcaactcaaaatgcaactggctcagcagatgctgagaacgcaaaatatcttgattctattcaaggtaaacttgcacagttccaagcgcaattccagtctgcgagcacgagcgttcttgattctggctttgtgaaaggaactatcgacgccggttctggcattctcggattctttaacactttgattgataaagctggtgttattccgggacttattactcctattgcctctctgtttatgtccatgaatgggaaagggcttatcggagaaaagggagaatttggagaaaacactttggacggaagtggtttatttagttggctgaaaaattataacaccaaaaaccgcgactattggcaggaacaaaatgaaattctgaaaagctacgctcagatgaagcaaaaactcagtggtgctgattttgaaaaagctctttctggcgcaagtattcagagtcgtgagttcgctaaatcccttgacaccgttgggaatgcagaggatgttgtttttagtaaaatcgataactttactgcaaagcaagaaaaaataggaacactcggagccaagattgcatcgacttttaaggggatcgggtctgctattgcaagcatggccgtgtcgatggcagcagtcttggcggcgacacagttaattcggataggtgccgatcagatcgacaaatcattcatgacaggcgctgaagccgcggaagtaaccagcgaaaacatagagaattatacttcgagctctaaagctatcgaagagaacatctctaccgtagaaggacttcgcgacaaattcgaagaattgtcgaaaggagtttccagtagcggcgaaaatattagcctgacagctgaacaatttcaagaatataacgatatcgtgtcgcaattggttgccatcaacccggcactggttcaaggatacaatgacgaaaatcaggctatcattgacaaaaacaactcaatcgagcgaaccattgagttactgaagcaacaacgcgtcgaagaagcaaaaaatgccgtatacggcggaaccagtgagaacgacggcgggaaaactaatgctcaggtagcttttcttgcgtcaaaggacgaatataaaaaagcaaagcaaaatcaacagatggttggaaatcagattgagacttttataaataatgcgtttactcaagctgtagctgacaaacaaggttacaaagttaaaaatattctgcagaaatacattggaaattcttacgatgattatttagatcagtatggtcttacaaaaggcggtatggcagattatctgaacaaaaacgccgacgctgttcacgacaatattgccgccatcgttagcgagcttaatgaagctggcgtcttaacgagcaatatgtcatcggaaggaagtaaccttattcagagctgggggcttgctggagaacagttaaagaactcaatcggtgatttatctaatatgattgggatggccttccaaacagatgaagcatattacgatacgcttaccgaaaagcaacagtcgtttttggataatttcgcagacagcattgactctagcattctcgaaggggatttggaaaattccgcaacagattacgctacagcaatgatgaaggttgccaaatataatgataatgcaaagaagtcgatggaagactacgccaacctgattgaaaatcgcggtagtatgactgtttctgaatatcaggaaaaagctcagaaagcgatgttgtcactcaagggaactttgagaagtgagttatcaaaagaagaactagacgccattgacttccgcaagatgttcggacttgaggatctccagaaacaaacagatgatctgaaagcgaccatcacagataatttgtctgatgttaagattactgatcctggaaagatggaagaaattgtaggtctttatcaaaaccgggtcgatcttcacaaagagatgtccaaattgggcgttacttcagaggaagttaacaaagctacttttggcaatctagatctgaatgatcgttcgtccgttcagtggacgaaggaaaatcttgagaagtataaaagtgagtttttaagctgggctcctgaaaaggaaaagaaaaaatgggaaaacgacactaaagcgatggggaaatactggcagaatttcgtcaaggatatggacggttctgtttctaccgtacttggctcgtggggtacattcggtaaagacgaaataccgattgcattcactcccttactggacgctaatggtacattgactccgctgagttctgatgaggtaaatagctatatcaatggcatcgtaggcagagccgcttcaatgccgggtaaattggcagacaatatcttgaaattagacaaagcacaatatggtattatagctggcatcggcgatactgcagaacgcactgcagatatcatgcatttcgccgggtcggacggtgcccttgctcaaatttcctccgcaattcaagaattttgcgcaacgaacggatattctaccggagaattcttcaacgctattcagagtggcagtgaagacgcaatgaaggctctcgcagccatgaccatgaccgcgcaggacttcaaccttgacaatctcaccggcgaccagattagcacatttaacaagattatcgctaccagtggagataatgtctcggaataccttggtaaactacaagcgattgatcaagctggacatcttggagagttcttagatgaattcaacaagaagttacaggctcaatccggagctgtaagaacggtagcgcaagatctcaccgactatcaaaatgctcttgagaaatcaacagacaatgttaaaactcacgaagatatggtcagcatttacgatgagtttgcaaagtctgtcaaaaaagggcagatcaatactgatactgctcgtgctcagatggagctgctcattggtaaggtcgtagatctcaaagaagccaaaaagtggattagtgaaaaccaaggtttcttcctcaccggtaaagatgaagataaagtcggacaagatctgaccggcggattcaatacacttcacaagaaatataacgcactcagcaaagaccagaaggctcttgttgacggcatgatgcaggtagattggaagaacggcagtatttctgtcgcagcgaacgatgttgttgacctcgctcgcgcgttcggtatgtctaccgcgtcgctgcagcagttctttgatctggttgactcgtactccaacccgacagaaacaaatatttccacggtttcggacaccgtagatcagctgaatcaggcgactatagatgccggcaagaacattgaaccttctcttcgagcatcgaaagccgcatgggattctttgacggttgctgaaaaacaagcgcttgaagcagcaacgaaaaatacgggcattgatccgactcagatgacgtacaacgacatcgagcgactgactgactcgtataatgcgcttaacgcggcaatggggaaagatttttcgaccgcgaatgtcgaaaaattcttttctggcataggtgaaagtgttgttactgttgagaaactgtcagatggtacgcagtctattgatatcaagaatgtatctgcttttgttgataaagtaaaagaattgtctgggctgaatatcagtgaaggcgatttgccgaccatgctgaatctgcttaataccaagactcgcgaaaacggtgacccgtataagtttactattaacggtgaggctcctattaccgaagaagacacaacacagcagatgatggacgacctgacggaagtgttcgagcataagtacaatcttaacatcgacacgacagaggccgaggcaaaaattgatgctcttatcgaaaaatgcaaatcattcgcagacggatcttatcgtacaggaactacggacgaatcaggcggagtaaagtatagtgagccgattggtcctgaatatcagccaaaaccaagagtaaagtatagtgagccgattggtcctgaatatcagccaaaaccaattgtattcaaaacagatacgacacaacttgatcaagccaaacagaatcttcaagaacttcaagaagcaggaataatcgatccagaagttgacatcaatgtagtgacgcatatggatgaaaacgcccagaagtttttggcgggacagaaattagtagacaatagtcaatcggtctcaataaacgcgactactcatatggattcgcccgcgcagacaataattaacggaactttatccccgagtattccagttacagtaaatgcttccactaacgctgatcaagaaactcagtcgctgcttaatggctcgaaacaggtaggcgtgcaagtttcggcaaatgttgaaactcctaatgatcctgttactccagccgctcaggaaatgggaaaagcattagactcagctatcaacaaacagcgtgtagtcaatgtaaatacttctgcggctatttccaatgttagcagcttggctgggttgatgaatagtgtcagaagcaagactgttaccattaccgttaataaaaaaacatacgagacaacaacgactggtagctcaggtcccggtaaaaacaaatacactggcggttacaccggattaaccgggactatgaccggcatggcttccggtggtcaatccgtcggcggcaaaacccttgttggtgagcttggccctgagcagtggatttctcgcgatggcaaacacagcaaaattgtcggcaagcatggcatggaggtcatcgataccaagcgcggcgatgctatcgttcctgcgaacattactgctggtcttatccgcggtggtctcaaacagtcgtatgatggggcatcttcatctggtgcgctagcaaatctggattatggaactggcggtaagtattataactggaaaggcccttcatccgcgaaaaccaagattcagaaggttaaggtaaccgctgacacttctaaactcgaggacgcagcgaaggaagctcttgacaaaatcaaagaagaagtcgaggacatcatcgatcagcttgagcacaagatataccttgtcgaaaagcagcgtggcgacccgatgcaaattgtagcttattataagcaaatccaagatgaggctcataaagccgccgaacgttaccgtgctcaaggacagaaagattcttctgaatacattatgtctatgcagaagaaattctgggaagcgcatgacagcatcatcgacacgatgaaggacatgtacgacaagatcacgtcggaacatgaaaatgctgttaaactggccgaacgaagtcttgaccgcctgctcgacactgacaagctcgaacgctctttcactcgtgctcagcgtaagattttcaattcggcaaagctgtcgcagaatattctgaacggtgtcgccaagaagggcaaccctctggccggcatcttcagcggcattgcagatagtttcgaaaccaagactgttgatactatcttctcgtctatcgatggcgatgcaattgagtctacgctcaacggcatcattgaccattaccgcgaggctcagaagaacctgcacaaggaagcgcagtattaccgcggcatgggatattccgatctcagtgacgaagtggccgacctctccgaccagtggtgggagtacgaagacgctgttaaggatgttaagcagaaagttatcgactatctctctgatatcgttgatgcagcaagcgactctgttgatacggttcaggacgttctcgacacgttcaagaaggccgccgaggaatactcgacaaatggtggttttatctccgtcgataccttccaagaaatctccaaactcggtgtcgaatacatgggatacctcaaagacgagaacgggcttctgaccatcaatgaggaaatgatcaaccgtgttatcaaagctaagactgatcagatggctttggaaagcgcctccgcttatgtggagcgtctgcgtctggctctgcaggagaatgatgttgtttctctgaataatctgttgaacgcaacggccgacctgaccgaggttcagtggggttccatttacgcacagctcgctatgcttgaccttaccgaggaaggctatgcgcaggctgttaagaatgtagatgcgtaccgcagcgttctggctaacgtaaaagccggcgtcggaattgactttgatgattctaaggatagcgttgacgcgctgttcaagtacgtcgaagacatgattcgagacgaaattgaccagcaggttgacgctctggaagagctgaaggataagtatagcgagatcatcgacaagaagaaggaaagcctgcagctctccaaggacgaagccgactatcaggacgaggtagccgacaaggtcaaggaaatggcaaagctccaagagaagattaacgctctgtctctggatgacagccgcgagtcaatcgcaaagcgtaaagatcttgaagagcaactcgccgatctccaaaaagaacttggcgagacgcaggcaaatgaagcctatgaccgtcagaccgacaatcttgataagatgcaggaggcttacgagaaggaaaaggacgccgagatcaagaaactgcaggattcgatctcatcagaggagaagctctaccaaatggctcgaaagagaatacaggatggttgggagtctctctatagcgatttaatgaagtggaatactgagtatgggtcagatctcaattctcaacttcaatctgcgtgggataacgcaactaaagctatggagaagtacaagttatcctatctcgaactgtacgataaacttggagacagcggttctaattcttcttccaatggctccaactccactactctcggcgattcgaacaaatatggcgcggggtcgcaaacggaggccattacaggaattgttcagcagatgtacgacaacagccaagcatggcataaagcatctcctgacgaaaagaagaaccttaaagaggcgaactctaaactagccgacaaattgaagagcaaaccttataaccttgatatatcctacgatccgcatactggtgtatggtcgttttctgacggcacaagtctatataaaaagtaccttggcaagctccacactggcggcgttgtcggtgatttctctactctgcgtcaagatgagatgatcgcaaccttgcagaagggcgaaattgttctcaataagccgcagcaacagtcgctcgactccattctcaaagtaatgtccgccattaccagcggtttatccgcttctgccctgccagacctgtccaaaaccgctcagatgcctgtttccggcgtaaaccgtgaagttgtcacgatcccgcgtgagaacgtcacgaacgttaccttcggcgacacaatcatcaagggtgcgaacggagacacggttaagcagcatgaagctgtatcccgccgcatggtcaacgacattatcgaagttctcaaaatcaaaaaataatggccggcgcggcatgtttccatgccgcgcctttctataggaggtgcttaacctgtttaacacctacgaattcacgttcgccggagagtcgtctctggcatataacctttttatctgtgatctggacagcaaaagcaacgaagacacggcgttcggtaacgaagccagtatcatcgaaacgagaacgaccggacgcgttcaaccaattcatcagggcgtaaactaccacgagaagcctctggagttcaaccttgtctttggttcagaaacgccgcttgaccgttacgattttcaagaggttcaactctggctgaccggctatcaggaataccagtggctctccatttgtcagcctgacatggaggactatcagtaccgctgcctgattacaaacctcgagccaatctctgttggctggctgccattcgcatttgaggctacagtcacctgcgactgcccttacgcttacggcttccctttcacagagacatacgaagtggccggcgaaactgaaatcgtctttcggaacaacagctcggttcgggagtatatcaagcccgtgctgaccattgaaccgacggcggctgacttctctatcgtgaacgctgatgacaatgggcgcgagtttaagctgacgggcgtacccgcggctgactctatcattacagtggataacaacgccggcatcatcaccgaatcccacggtacaaacctgtatgacaagttcaatatgaattttttccggctggttcgcggtgataatcacctgaaaatcactggcagcggcaagctcacaatcagcggtagaatgctgtacaacgtgggcgcataaaggaggtctgtgtatgtatctcgattatacgcaaatcacctttgacaaatttggtcggccggagccgcctaccctgctgctccaaacggctgacgagcgcacgattggcacacttcccaacgtggcaaatctgaaaatcacagttaacttttccgagacaagcgaaatctcttttgatctgcccgcctattctgacggcgtgtcgacgccgctttataatcaagtggtcggttacaaggtgattcgcaccgagcactacggcatctttctgctgatgaagccggaaatctccggtgacggtatcgaagagattaagtcggtgaccggctactctctggagaagaagctggagaacaagcagttcttcctcgaggagggcacatttaacttctggaatcccgcaacgccggatgatactattctggggcgaattctggaagtatcccccggttggaaggcaggatatgttgcgccgtctttgattggacgttaccgcacgttcgaccagtatgacgactacgcgctgagttttctgtatgatgacgcaatggatacgtttcgctgcgtgattgtattcgacgtgtacaataagacgatcaacgcttatgatgcggacgatgatgtgcctgccctgccgatttaccttgggttcgacaacctcgtaaccgaccttgatatcacagaactgactgatgagttagtaactgctatgacaccaagcggcgcggacgaccttgacatacgacaagtaaacccgaccggcacgaactggatttacgacatctcgtacttcattgagaacggtgatatcccttctgctctggctgaaaaatggacagagtggcagaaaagcgtgctgaaccgtcaggaatactacaagggattggtcggactgcgagcttctgcaacagcgcggctgctctccgaacaagctaagctggttgaccgaaaagccgaattggacgacctgacgaatcagcagtctgtaaccattcaggctctggctctggaaacgaccgcggatggtaaggcttcgcagcagaaaaagctcgacgagatcaacgccaacatggagaagaaaaagaaagaggttgccgaccaagaagctgtggtagcagatatcaagaccacgctcgacgcttccaaccccgactcctatccggcgcaaatcaaagccgtgaatgacgagctgaagctgacggctttctttaccgcagacgaatatgctttgttgcggcactactttatcgagcagccgctttcggatgatacctttgtcgcttccgatgttgataccgctgtgaccggtgagagctccaaggtgacgaatggcgcgattgcaatttctgattcaaccctcgcgcaggttgacttcggcgagatcaagaagaagatgtacaccattgctggcggcactgctgtggtaacagcggcgaacaaaatgtccatttcaattatccgtggtactctggaacacaaggccggcgacgagtttgtgttcagcctgtactgcggtgaaatgaaaatcggcgaaaaaaccgcaccaagcggtctgattacgctgaccggcacgctgtccaacctcaagaatgacattcacgaggtaaacgacaaagaggtcattacctatgagggcacttctctgtcgtttgatatcacggcggccgacctttatatgacaaccaatgtgtcggactaccaaaagtattccgtcgagatggagctttacgaccatgcggtcaagacgctcgccgacgttgcttcgccgacctatgagttcagcgttgaaaccggcaacttcatctgggcgcaggagttcgagccgttccgaaaaggactggagctcggcaaaggtgtttacctacgtctgcataatgatgaggttatcacccctgttctgattggattcgacctcgacttcgaggatcaggagaagctgtcgctcaccttctccaacagattcaagcgtcacgacaacgtggcgaacctgaaagagatgattgagaacagctattcttcaagccgcagttttgacgcggcgaagtatacctacaatcagacggcgaatcaggcttccaaggtttccgagttcatgaacagttctttggacgcggcggtcaattctattatcggcgcaaagaaccagagtgtccgcatcgacggtgctggtctgcatatcggcgagcctgactctccgtaccagattcgcattattaacggcatgatcgctatgtcggacgacgggttccagagcgcgaaagttgccatcgggcactttgcaactgatgaactgggcgaccactggggcgtaaatgccgacatcatcggcggcaagctgcttatcggtaacggtctggtaatcgaggctccgaacgatgacggtgtgatgcagttcaaggttgacgctaccggcgcttggctgtataactctacctttgttttggcaaaggatggcggcggaaagattttaatcgatccgcgctacggaattgcgtctggcaagggagacctgtatacaacgaacggcacgacagtcactccctcgtttattgacgaggacggcaagattgtgttcgatgatgatatcacgctgaagggcttgaagattccgaagggtacgaatttttacatcgacgccaatgacggcaaggcttatttccgtggcaatatctatgccgaggacggcattttcaacggcaccgtttatgccaaggacggcgagtttaccggtaaagttactgctacaagtggaaagtttactggcgaaatcgaggcgaccggaggtacttttagcggcactttgaaagctactactctggacggcacgctaaaaggtggccaagacggtggcactatcacaggcgttagtcttgatattggcaacggagcgtttcaagtagatagctctggtaatgtaactattaagagcggtaagatcagttggggcgcggttaccggaaccgatgcgattgaccagaagatcgagaatgcacagacaacagcaaataatgcctcctctgctgctgaagatgcagcggatgacgtttataaacttgctcatggacaatacggtgaagcgaaagctccgtcggttacttttataacaggcactaagatatctgctccgactatagaggctggtaaattctatggtagtgcttattataatattgaaggcggagctaaattgcagttagacggtggagcatacggagattttgttatttatcgagctaatggagataagacttttcgagttttcgacgcagtagataccgttgcattttcatctctttccgaaaatccatttttacagatcaataacaaagacttagttcaattatatggaacatgggattttagccacgcaacggtcaatggactcacggctacattcggataaggagactgatctatggctaccgtttccgtaagaaatattgagtctaccagtgttactgttcgtgtcagcggcgtaaaaaaaggcgacgacctgttcttcttcgttcgtctgcgagacgattcatcggacgtatcaggaactgattatgcgactgcaactagcacgacgatgagcacagatataggtggtctcgaacctgacactgattatatcgccaatgtccgagtaaataacgtatggcaaactggcgcaaaattccgaacaaaaacggaacttaatccttatttttataccggcaatatcggaacaaactctgttactgtttatgttgaagatctcgcttatggccaaagcattcgtgtactaattcgaccgtataacgattccagcactaatattgttaatcaagactatagtgcgagcggttcttctttctcgaagacatataaaaatctttcgccgaatacacgttacgccatcaacgttcgcgttgacggttcatggctgggcgcagatgaatttacgacagacaagcccgccatatctaagtggtcgtggagttcttcaaacggtactgcttcagcagctcagaccaaagcggcgtatgatgccctgataaataaggggccgctttcagacttctcttatagagtctggaacgacatgtgcggtaaggtcattgagattgaaaatgcccttggacagacttggagcacaaaatatgctcaatatgctgacactaaaatgacaacatctgataaaaggctgaccgcaacacggttcaattcacttcgtcataatatcggccgcagttactctaccggtattaacgaagttgcctcaggcgacactgtgtatgcttggtactttaccacgctcgcccgatgtatgaatgagtggatagatcaaatctaaaggagcacacatgacaaaagaaattctcgcggaagtagcgcagattcacaatcgtctggcggaaatctcagtccgcggcgatgatgctatccgcatggcagaagtgctgacgcgctgccgaaatctcgcacagcaactctcaaacctcgcagaagaggacaactctgcggactaagaaaggcggtgaacttatgtcgctttgcgaccaatcgccctatcagctgccgaccgtcacatttgttggcggtgcaacacagcagctggcgttccatacctactttgaggacaacggccgcccgctcagcatgagaggctgcaccggctacttttctgtagctgagtatctgaataaatcttccccgctgattaccaaaacgatggatatcatcgagagcaaaaccgacgcgacggacaacattcttcgcgtcgaactcgaaccatctgacacggtcaatctggcggggaaatttatttatcaggtcacgatcaaaggctccgagggagatgtggacattccctatcagggcatcatgtatgtgacgcgcaatattgacaaaccaatcatcaagtaaaggagaaaaggcatgaatactaagtattttctgaaccttgtagcgggcaatgtattccgttccaaggagacgccggctattccgacgaagtattacatcggcctgagcaagaccgagcccaatgagaccggcggcaatgtaacggagccggagactgcagcaggctacgctcgtgttgagctgaacagtctgggtgagccggttgacggtctggtaaccaaccagcaggcaatcaatttcaacgagtctaccaacggctggggcactgttacccactttgttgtatatgattccaacgaggtcggcgcgggcaatctgctgatgtacggcgcactgactacgccgagaacggtcgagacggctaccatcatgaccatcaaggagaattacctcaagctgtccgttcagaacccgaccgcctaagtttaagataaggggacaagcatgaaggattataaactctatcttcgtgaccggctgatcgacattgatctggtcaccaagtctcgttacaccgaatgtgacctgacgatatcctctatccccttccgtgaatatgtcggcgaggtatatgacgcaatcatcgtagacagccatgtggtcgatacttatctgaccggccttttctctgtagatgaaggcgtggttatccattcggagattgaccagattctgcggcacgttatggaacgtggcatgaacgcgcttgttattgacagcaaagcggagctcacctcccacaagattctgagctccttccctaacgcgctcacgattcacagcgagccgaccgagctgcacgctgagaccttcgaacaggctgatgacgttgttgttctggcggtagacaagctgaatatggaagtacgcaaaaagctctccggcacggagaatagtttggagattcagaccaccgcacaggagattaagcaggcgcttgaaaaagcgaccggcgcacttcccttctcctcagaagttcagcagacttggagccacaaattcgataaagcccagaacgcattgcattttcaggcagaattgcaaagtttatgctatcaacttttctctgatggcggcatgacagcgatggagccttacgcggcaccgctacaggtggagattctttattctctgggcggcggcgcttcttctttcgcccttgattctacagttgtagaaatagcaaagaatagtttcctgcagaccgagacttccgtaattccagtcgcgttcccggttcagtttttactgacctatgccgtgggtgcagaggctcaaacagcggtttctgcggcagttactaatctgtgctacaactatttctccggcggcagctccggcgtggagatcacagcgaagctcggcgagcttgaggaacacttcccgctcggcggctttgaaaatgctgtccagatagagaatacggccgccggccattttctgctcgaaaagagagagcacgctgattctgatagcgtcatcgcagttgcgtgtgatgcagcgttgactggttcttctcctgagctggcttctgttgtggtactcggctgtacgattgaggggtttatccgaagatatcggctgctgtccgaggttgacgatgaatctctggctgacatagacacgatgacgctcgacaacttagattatgtggttttgtaagaaaggcggtgtgagatgagcaaaacacctaactacgacctgttcgtcacagatgatgcagggactaaatttaaggactggcgcgaacagatggcgtccgagtccaattccaatatggtgaagatcgacgccgccctttctggaaaggctgagcaaagccgttcggtcgaaattacgctgacggctgacgggtggattggcgacgccgcgccattttcgcaacaggttgcagtagcaaatctgaaggctgataccaatggctctattgcgattgcaagcggcgcgacggcagagcagcgtgcggctgtccgcaaggctcagctttcgattgcggcgcaggctgatggattgcttactctgaactgcgacggcaagaagcccacggtagatattcctgctgtggttgtactcttaggataaaggaggatgaaataatgcctattatttcggcatttccgacgggcgaaagcaccgtcgattatactggccctaaatccggtttgccatcgctggaagagggcaaggttgcgtatgtaaccgatgaaaagcggctgtataccggcaatgctgatggcacaaatacgcaggttccgaatgaagaagatgtatcgaacgctgtgagcggacatgattctgatgagaatgcgcacgcggataaatttgcaaagtatttaccgcttgaaggcgggaaaatgactggtgcgattgtagttaccaacaattacaataaatatagtgccttagaaactccgacaggttatacttatattgatatatatgatgatggtaaagatgttactacgggtacgactgaaatgcacaccgttgtaggtaaggggccgggataccttactggggagcatcttgtaatggatggtgcaggcatagatttacgcagatacaatgggacgcttgataatactcaagttgctttgaagttaaatgccgaatccaacacagtaagaatagagcaagtaggtacaatttctgacaacagcgatgtcaccacaaaaaaatatgttgatgatgcaatctccgaagccaataccaactatcttcctcttaaaggcggtacaatgacaggaagcattatcgctccaagtaacacctctgctatccgaaattctactaattccagcagagtgtcgatacatgatgaaacagccggacttgcttcgggaacagtatcagtattgtgtaattcaagtaattctgataaccccaatcttacactatcggcgggttcaactaatctttatgtgtcagatgccaatggtacggttcagatgactcgtacaaaagacattactcatgacaatgatattaccgacaaaaaatatgttgattctgctattcaggtggctattcaagacacttgggaggcgagctattgatgagcgttcaggagactaatcttaaagctatcgccgatgccatcaaagctaagactggggaaaccggaactattaaagcatcggaatttgcgagtaaaatcagcaccattgagaccggcatcgacacatctgatgccactgcaggagccaaagacattctctcaggactgaccggttatgcgaataaccagaaggtaacgggtactctagttcctattgaaaaaccgaaatgggaaagttccgacatgcctgctagcgagagctggttttcggtttgctatggtgcgggtaagtttgtggctgtgaattatagcagcaatatcgctgcttattctaccgatggcatcaactggactcagactacaatgcctgctagtggaatcggaaactcggtttgctatggtgcgggtaagtttgtggctgtggctaacagtgataatgtcgctgcttactctaccgatggtatcaactggactcagactacaatgcctgctagtcgttacgactggggctcggtttgttatggtgcaggtaagtttgtagcgatagctagtggtgtagagggtgtcgctgcttattctactgatggcattaactggactaagactacgatttcggatgaggtttggtggtattcagtttgctatggtgcgggtaagtttgtggctgttggtggttctgatgatcgcgccgcttactcgaaggacggcatcaactggactctgactacgttgccggctaataaaacctggctctcggtttgttatggcaatggtaagtttgtagccgtgtctaggaccggtaatattgcagcttactctaccgatggtatcaactggactcaggctacgatgccgatttctgcagcctggcaattggtatgctatggcaatggcaagtttgtagccatgtctagtagtaacaatatcgcagcttactctaccgatggtatcaactggactcagattcagactacgctgccgactagcgcggcctcgatttgctatggtacgggtaagtttgtagctatagttttcgggagtaaagtcgctgcttacctcaaagattcctttgattcctgggcatagagaggaggtatgatattttgaatattcaagaaaccaatcttaaatctatcgcagatgccattcgtgataaggacggatctactgatccaatcaaggcttcggattttgctaatcgaattttagcaatccagactggtgtggatacctccgatgccactgccactgccgacaaaattctgtccggtaagactctttatgtcaatggcgagaaggtcactggtacattaattcccatcgagaaacctgaatggattaccggaacaatgccagttaatacatcgtggtcttctatttgttatggagcgggtaagttcgttgctgttggtcttgatactcctgtttattctactgatggcattaattggtctaagtctaatgctacaattaaggagaactggacttctgtttgctacggcgcggataagtttatagctgtagctagaaatggtgcagtagcttattctcttgatggtattaattggactttttctcgtcttggacctataatgggaaactggaattctgtttgctattacgataaaggtttcgaagtaattggacagggtggaagtgaggattgcgatccagcttattccgaggatggtatcaattgggaaccggaaggtttgctattctatgctgataattggacacttgcttatggtaaaggcacactagtagctgttgccgatggttcacctgaatgtggtgctatctatagtaatgaaagtaccaaacacggttttagagaggctcatttgacaaaaaataaaaactggtcctctgtttgttacggtaatgggaaatttgtagctgttgagaaagatagcaatactgcagcttattctgaggatggtatctcctggactctgactgagatgccaacatcctcaggctggggttctgtttgctatggcaatggaaaatttatagcaacgtcatttacccaagggctttttgcttactcgatagatggtgttaattggagaagtggcacttatccaggtggagctcagacaaaattagttcctgttacttatggtgcaggaaagtttgtagccgtttgcaatgaatcttcttattatctcaaagactcctttgattcctgggcctgaaagaaagaggtgatctatattgaaactttgtctcggcagtacccctatcaagtcgcttaatatccgcaagctcgatgtggatactaacgacgctaccattgtcgcatccgacatgcagactggctctatcgcttatgcgaagggtcagaaggtgaccggtacgggcagtaatggttttatcatcgacgaaattcctagctactcctttcgtcgtctttaagatcacctgtgcgagcttcagcgtcaatatgagatagccgaagcctacctgaagggaacatatgcaaataaaagcaccctgtaaaagggtgctttgggctttagttaaatgtaaacaaaatagtcgctagcgtccgataactgttgtaatgcgtcttgatatgttttcatattttcttcggatacagctaccaactgggcagcaaaccgcctatatgttgaactggttggtgtaacggaatataattctccggttatcaaatatagcggatatacagaagaaagcagtggctctaaatgactgtttccttcgattatcttggtgatttcgcggagggaatcccattcttctccgaggctattttttgcgtttagaatgtagtacacaccagaagacccataacttgagttataggctcgatatgcgaaatctgcaacttcctgctccgacttaatagctttgttcaggtagtttcgaatcgcgtcatagtcatattgggtcagaatatcaggttcttctgcatatgtctttgtgtaatcatatagaacaggatcggagaatgcactatagaaagatcttaattcatctgtagattcattttttattacgtcatgaactctaacccgaaaataatacttagtattcggttctattgagaatgaatttcctacgccaaattttatatgattatcgcctccccagctaaacaaatggaagctaccatcttgcgcttttttaaattccacatcatatccgtaatctgttcctttcactgtatcccaaaaaacaaatgtctttcctcttacggtagaaatccttacatttgtgggagttggatatatctctaatccagcctcttttgtcagacgcacatcagacataaaatcctcgttaactgtgccatcgtctatcaatttcttcactaacgtagacgaaccatctttcatattctgcttgagcgcattataagagataagagcaacgtctccacgagtgaaattagtggtattcttattgtattgttgattggttaatttgagtttatctgagaaactccatactgaattatacgaaaagtccgtgtcgtcagaatagcccaacgctcttaacgcgaatgtgaggtattgagcggaattcacacgagactttcctccaaatgttgttgccgataatcctttagccaatccattgttatatgcatacgagacgtaaggttttgcccattcttctacatcagtaaaaggaatgttgacatctgttttcttggcttcatcttctttgccaattaaacggacgagcatggtaattgcttcatctcttgtcggctttgcgtccagattgtaatttggtgttccatctgctttcgtaccaaccccgttaaataaacccagctcattaaggaataacgctgctgtgtgttgctgagaattataggcggacgcggctggcataatccatgtaatcaaaaagattgcaaggagacctttaagcactttcttcatttcaattactcctttaccgggaacatggtaacaacattatctgtgtaaccgccgacgagcatcggatgagtccacttcagaatcagctttctctgttctggctcgcttttggagccagtccaatagtgatgccagtggcctcggcgagtatgcgggcgtttatgacttccctgcttcgcttcatccgtcgaaggggttgcttgcggagcactggattcctgttcggcgcggcgcagcgtgtggccaattacaacaccgacgtccttcatgtctatctcgcggaatttatctttaattggctgccccggctggcgaggccgataaattcccttctgtttaggattctctcggatatccgcttggtcactgcagacatacagatataactgcattgcgcggagtaccacacgaacactttcgtcaatgtgaatgttgttcaactgaaatttggcgaaagtgtgatattttgcggttgtggctacggtatcataaatacagtcataaaccgttggcttcgtcagctctaacatgaacgtcttggtgtgttccatgtcatctgaaaaaggctggacgcggaactctttaacgtgggaattcgcatcttcttctatccaagccataaacttgaggggcagcgagtttccggaaatcggcttatcggtctgaatatacacacacggataaggaggtctcaacagaatttctgtagggattttgtcctcttctgttgtggcgtcggcttgagcgactaactcttgcgccaaagtatggtcgaagttgtagataaccttgtgctttcgccagatgtataatcccgtgagttcactggcaaggcgagcacgcccgtccttttctaaatgacactttactcgcagatattcatacgctgcgcctattgggagatcgcacacctcgctcactcccatttcttcgtgagactctctgcacaacacgtctaacgtgtcgaagcagccgggagccattttgctccacttttcgcataacttaagcggagtttcgttctctgtcactggtctcccaccttcatttcttcattgtataaattatacaatagaatccacctaacgtcaataaattttgcaaagaaaggaggctcgccatgagcgtgatgcgtaatgaccggccttaataattttataaatctatttgggcaagtcaccctttctaccgtcgtcgagttagttctcgccggcgtttttctttatctgatctacaaaaaggtcagagattttctcattgaacgctacgaggccgaaaaagcccgcgaccagcgaatcaatgaagcactcgacgctgtgcataaataccctgagtaccgcgcccagagcatcaagatacagcaaacgctggaaaacgagatacagaatatccgcaaaacaatggaacgctaccaagccagactggactcagtagaagaaaccaataaacgccgcgagtgcaacaagctccgcgacagacttcttcagagttaccgttactacacaaacgaagcgaccaatcccagcaagtcatggacacagatggaggctgaagccttctgggggttgtttcgcgattatgaagaggccggtggcaacggatatatgcactcagtagttcagccagcgatgaccgaactgattgtaagggaatgtccgaaatgtccgaactcatcgggaaaggaggcgtaacgcatggaatactactcctctgtttttacatttgacgattggtatcttgacaagcctgttgggacgattgctcagcagtatgaccatctctcccgctcgcttctggtggcgggcaatctgccggacggttacatctggcacatgcttgtgcaatgcggcgacaatttcaacatcgtgttgatggaacccatcgaagatactgcctcggctgtggctgaccttccggaagaggacggcgagccagagaagaaacccaagttaatcggcgcagtcctcgaacgcggctgggtcggcgaatcgggcaaatactctgttcagctccgcggcgtcaaaggcgaagaggttcgtcataccaatcttatcaccatccgtattccgaagtcgatggccggagaagcacagtggccggaggttccatctgagtttacccagattgagcatcgtgtaaacgagacctatgagaaggttaagaacacggctgccgaggctgaaaaagccaagaacgctatcgaaaacatgggcgcgacggccaaatcggtagagcctgacgaggaagcctctgttgaaaagactgtcgatgaagacggcaacatttcactgaacttctctattcctaaaggtgagaagggcgacccgggcgacgttgttgcacatgagggcttatacggtttcgaggtcaatcctgacggatatctcgaactgcattatgcagacaacacagctgcgccaaatctttccatcaacgaagatggttatcttgtggcggaaatttgaggggggtgaacgcgcatggcgaaacttattcttggtaaagtagttggcccagagggcaaagccgcgaccgtcgaggttgaatcgaccgaaactgtggctgcaggctcccccgctctggttgaaaatgtcggcactgcgaatgaagcaaagctgaagttttccatcccgcagggtgaaaagggagagaccggcgcaacgccgaatctttcctttgaggtaaaagctctcgagcctacggatgctccggccgtttctgtcagcggagacgcagagaatccgcatctggtaatcagtcttcctcgcggcgagaccggcgaagatggacaggctgcctatctgacaatcggcacggtgactacgctggctcctgacgagcaggcgacggccgatattaccggtgtagcaccgaactatgttctgaatcttggtattccacgcggtcagggcattgcttcggctgacgatctggttgaagttaacggcttctaataaagtagattcgggcgctctctggcgtccttttctaatattttcacacttttcacatcatgatggccgctcaatgcggcaagaaaggaagaaaacactatggcaactaaactcgtattttgcggtaagaaggtaaacctgcctgcagttcgtgagcaggcattctatctgaccactgatacccatgaggtatacttcggccagaacctgtacaccgagccggtacgctttgtacctgagcgtgagaccaccccggcacagggcgttctgtacattctgccctccggtcttggtgaggtttacgacggctccgcatggaagactgtcatcaagccgactgttaccacgattgaggctggcgtaaccgacgagcaggtcgcaactgctaaggctgtaaaggactacgttgacaacctcgttaccggcggcatcggcgctctgggtgcactggctaagaagaacgaggtaaccgagactgagctcggcgacgctctgaagaagaagatcaacgacgctgctgctcaggcttctactctggttggcgaggacgcttccaagtctgctcgcgcaatcgcagctgaggaggttgcgaagatcgttgacggcgctgacgcttctttcgataccctgaaggagatcgctgactggatttccggccacaagaccgacgctgcttccatgaattccgctatcaaggctctggaggctatcgttaagggtatcggcggcaccgatgagccggccaccgttgttgcatacgttaccgcagctatcgacgctctgaagatcggcgattatgcaaaggctgctgacctgactgcagctgttgcccgcattgctgacctcgagtccaaggttggcgttctgaacggcggcgctgacgttgctggctctgttgctaaggctctggctgacgctaaggcttatgctgatggtctggctaagaactatgacgcaaagggtgctgctgataccgctctggcttccgctaagacctacgctgatggtctgaacaccaccatggacggtcgcgttgccgctgttgagaccgctctggaagttggcacgttctgatcgcccctgttgtttatccgccccgcttctcgcggggctattctttataaaggagggggtgcgaaatgggctattacttccgaacctatgagacggtgctcagcaaggctcagaatacaaccactgtgccaattgtgccgggacgttatctgatctgcacagacaccggcgatgtcttttacgacactaaagataaggttcgcaagcacctgaccgacatcattgatgtagctaccgagtcggctcgacaagcaattcttgcgccgatggagcgtttctacttcgtgaaagaaacggctcacctgtggcgttataccggcggggcatgggttgacctcacccccggttatgagacagaggcggtgtttactaccctgtcggcggctgcttggagcaataagacgcaggctctgacgattaacggattggctgccagccagaacggcgtgatcagtctgacgcagaatatctcggcggccgctttgaaagctgctaagaaagcatctctgcgtgctaccggtcaggctgcaaattcgctgacgatgactgcggatggcactgttccgaccgtagacatccctgttgtggttatcctgatgagcacagcatcttaaaagataagccggggcttcccggctttttctttaccaattttcaataaaacgcgaaaggagctgtcatggctcgcaaaagaagaaaaaagcgtaagctcgagttctccaagctgattctggtgttcgagaccgtgctcgtggcttatgtgtcgcacagggttctcggttttgtcggacgggcgattgagttggactacacagggtctctcccctatctgacgacctttatctccgctgtctgggcggcatatggtacgagcgtcagcttctatcagagcaaaagcggcaaggagaacattaaaaaaattgagatcgcgccgccagtttcttatacagataccgacttcggatatgagaacgacgaccgcgactgctgataacttttaagtatattttaacgccaaatgattgactttttcacgcgaaatattgtataataaaagagtggaaacccgacagttgccacaacatacatatacttttgaaccgaggggttgcgccctcaattctcgagccgcctgttgcagcagacggctcaattcttgctatttctcatgtacagcgctaacgctatcatgctcgcgactgagccggcaatctgtattgccctttcaatcgctcccagaatctcaagagttatatgtatcgcctcccttcgagaataatttcccgcgagggctatacacacgcctccactccgctctcgcgggatgacaggcaaccgtcttttaaccattcctaaccactaactcacgctactcgctcactattggttgggtttccactaaacacattataccgtatttttgccaaaagtcaattaaatggcattttcgacagtccttcgggattgtctttttttatgcccgaaaggaggcaattatggatactaatcagattgtacagctcattgtggctattcttaccggtctggcaacctgcatcccgcttgctgtaaagctggtggagtatgttaagacggcgaccaaggaaaagaactgggcgaacctgctcggcctcgttatgtccctgatggaacaggcagagaagaagttcgacgacggcgcaaccagaaaagaatgggtcatggctatggttaaggcttcggctgactacatcaattaccctgtagacgaggatacgctgtccaagatgatcgacagtctctgcgatatgtccaaggttgtaaatggcacgaccgaacaggaggtagagaccgtatgaagacccagtatggctttacgctcatgacgattggcgagtttgagacttggctgatccagcagaaggtcactcgcaggatcaccgtaattcaggagcatcacacttggtctccctgctataagcagttcaacggctcgaatcacctccagctacagaagaacatgcgcgactatcatgtcaacagcgcaggctacgcagacatcgcacagaacttcacggtattccctgatggtatgatctgcactggtcgttcgatgaacgtcgcgccggccggttgtcgtggagcaaacacgaacggcatctgcattgagaaccttggcaacttcgacgttggtggcgacaagatgaatgctgcccagaaggatgttatcgttcgcatggctgcggctcttctgaagaagttcaagctctcgccggagaccggtatcacctatcatgcgtggtggacggacgatggcaagtctctgggaacttacgtcgcaagccgttcttgtaagacctgcccgggcaccgctttcttcggcggtaacacccgcgcaagctacgacaagaacttaaagcccctgatcgtgaaggctatgaatggcacttacaacgtgccggtaaaggaggaagaagaagtgactcaggaacagtttaacaagatgatggatacttatctggccggccttgctaagcagcagccgagctcttggtctgagactgctcgtaagtgggctgaaggcatcggcctgattaagggcgacgacaagggcaataagaactacaagagcttctgcacgagagagcagatggttcagttcttgtaccggtttaaggatatgaagtaagttttggggcgcgtttgcgccccatttttttacgaattctgtacaaaagcagaaagaaccgggctcttttataactcggttctttattatgtatatatagtttcgttcatgtttattgcttgtaatgttgcgcatattctgctaatcggtgcactgatccatcgttggattagcctcgtgcgtgccaacggtaatgctgtccagcgcacagtaagaagcggtcggacaatggtttgcgcactgctccaccgtacagtgaatggacttgttgcagcgatcgttactcatagagaatgacctccttttgtgatttcggtaatattatctcactcgtttccacaaattatactttggaattgcggaaatgctttccgttgtgctatactaaaacaaaaacattacaataaaggttgtgacattcatgcaaaagggagattccgcgaagctcaagctgctgctggcaggcatttcagcacggctgaccaaaaaccgcgatttttttgtgcaggcagactgcactctggtttccggcaaaaagaaatttgacgcaaagctgtcccgcgcggacgaggactacacgctgcattttcagggcagcgaccgccgcgtagacgcggctgaattctgcgccttctttgccgagcaggctgagaaatacgacgagagcgtgctcacctataccgagcgcagcacggtcgttacgctgtccgtgacggcacgcggcgtacagatgaagcaggccgagcgcgaagcgaccgccgaggaaaaggcggctgccgccaatccgctgctcgacagcggccggcagtacctcatccgcgtcgatcaggcggcggcactgctgcgcgagatcggcatcctgaccgcagacggcaagctgaaaaacgacatgatccgcaagtacaatcagatcgaccactacgttgagctggttgcgcccatgtttgagcaggacgacagcgacgagatcgtgctgctggactgcgcctgcggcaaatcctacctcagctttgtcatgaattactacattcacgaggtactgcatcgccgctgccgtgtcatcggcgtggacatcaaggagcacgttattgacgagagccgtgcgatggcgaagcgtctcggctatcacaatatgacgttcatctgcgcggatctgcggacgtaccagccgccgaaaaacgtcactgctgtgatttcgctgcacgcgtgcgacattgcgaccgatctggctcttggcacagctacccgcgccaaggcgaaatacatcgcgtgcgtgccgtgctgccacaaggagctgctcgatcagtacaccatgcccggactcgagccgctgaccaaattcggcgtattcaaggcgcgtttcaacgatgtgctgaccgacagcatgcgtgcgctcaagctggaagccgaaggctacaaggtttctgtcgttgagtatatttcgccgctcgataccccgaagaacctgctcatccgcgcaacgcgcaccggcaaggtgaaccaccgcgcgaaagccgagtacgacgccgtgcgccgcacgctcggcacgacctcggagcttgaccgccgatgcgcggaactcgacaacgagtttttcgtcaccgatgaggacttgatgggttaattcccctgtttgcgttttccatgtgcatttcagacaatctgccggatacgctcttgttctttgtgtaaatctgcattataatttttgtatactctcatgaaggtgatgcctgtgaaaccacccgacaaaggcctgctgctctcgtcgcatgtggactttaccattccatctccgtttgcgcaggagcacctgtattatctcatccagtacggacgctaccagtgcgtacccggctatgaggtcaagcaggattttctggatatgtacctgtacgcgtatgtgcgcagccatacggccggaggcgtctggatggacgtataaagcagccccatccctctttgacggaagtccccctgtattgaaggtacagagggacttcttaatgtaacaccccggaaaatctccgaatagattgatactgaagttgcttcaatttttgtttggaggtaatatacatggctgaaaaagtttgctgccctggtccgatcggcggcaataacggcaacagtgcaggcggcttccgcgaagcggtctgcgtccacaccaaaaaggtttacgactcctgccgcagcaaggagtgcctgcgtgacatccgcgtgtatctcacccgcgatgcgcaggagctgatcaatgccggtggcattgcatctgtgaagccgcgtgaagcggaactgctctgtgtttccattgatgttgagcggattcagtttaatcgaggtttctacagtgttgatatccgctttttctaccgcattgaatgtgaaatcagctgcgtaatcggtcgtccgcgtatcgtggacggactggcggtatttgacaaacgcgttgtactgttcggcggcgaaggcggcgcgcgcatcttttcctcgcagtatatcgaggacggccgcgatgtgcagctgcggcctgacagcaacaagccgactgcggtcgtagaggtcgttgatccgatcatgctggacgcgcgtgtggttgcgccggaaaccagctgcaactgctgctgtcaaagcataaaatgttataggtttacgaaacgacaaaaaaagcgccgtcaatcgacggcgctttccttcacttccccagttttcctgcaatctttccgatctcctccagcgcaaatcgcagctgttcattctcctcctgcactgctgcgggcagcagcgggatttccgccgccatcggtagcgccatatcgggtgaaccctcgcccagcagctcccaccgcagctttgcatagccggtgtcatagacgatgagcagaccttttgccacgctccccacacggttataaaacttgtactcgtccaattccgtgccgcgcagcgtttcccagtccacgccagtgcggtaaaccgtcttgcgctggcgcagcagaccgacgaccttatccttcttaacaccaagccgctttaccgcctcgtcgacaatgatacacccgcgccccatccactggtgcggcaggtcgacggaaggcttagcgcggtagccgccggtgcggcgcagctcgggcagaacctcgtcaaacagccacttctcaaacttctgcgcggcgggcagacgagagcggataataaggcggtacaggtcgccctcgctaatgaaattaaccgtaatcttcttgtcaggagaggtacctcccgtttcagtagggaccggcaatgcttctgtactgcaccatatggattggtatatcctaacagtttcgccgcatcattcgccggaaacaattcctttccgttttccaccagaatgttcaacttgccaaactcgctgttagataccgtcagcataccgtcgttcatgcctgcacctccaccttgggagcgcgtgcgccgaggccgccggacagcaggttcaccgcaagctgaaaaccggtcaggaaaccgaattcctctgcgcaggcttcgtaattgcttacaacgtccgaaatatcgcggttcttgaaaatcggctccatctgcttctgaatttccgcgtttaccggatttgaccagaattcgtcacggaaggccgtgctctcgtcctcctgaatatagtcaaagtagagcttgctcaaatcgtatttcataaaaattctccgttcttaacttgtcgtccctcggagaatgtgatatgatagatttatcaaatcctctgagggtttgtgtttggggctatccgcgtttgctttggtcggcgtgcgggtagccttttactgttttttgtggtactgctcatgtatcccacgtcttacgacttccgatcgtgacaaaccatcaacctgacagcaataatccaattctgacaatgtggtttcgtctaaacgaacgcgaagcataaaatctttcgggttatctgtgagcttggtacctttctgtatagcagacaccttgtcacctcgctttctttgttgctacaatcttattatagtatgtagcaacaaacttgtcaaccgtttattttctagaccacctgttttagggggtctagaaaacgctcatgatagcgtcgtgtttcccgacccatgggtaggtgtgcgtttcacgcagtcccctctccaaaagcaaaagggtgagccttcgctcacccttctattttttgccctgtgttaatttttttctgattgctaaaacatcaatagatggcttcatcttttgccgctcgattaaaaccaaatatttcttcgccctcttttgtacctctttcagtaacagttgattctgaattacataatgcgttccagccattgtatattctttcttgatatactttttagatacaggaaacatattaccaatcagaaatactctatcttgtccagcaattttgccaatatggtaatacaaacacataccatgcgcttgttcatctttggttattttcttttgatatgtagcaacctgtgtgcttaatggtatcatccaccagacaccggttttatcttgaaaggcacaaaaatatggacgattctccgccttattatctgaaaaatatgggtttttgaaatcaataaaaaattggtccctaatactgtataaaccaaattgcacgattgggtttttgcccatttctttacccccattaccgaaaaaagccctcccgtaggagggcaatttcacgttagctacttgtatcccgctgccaacacgcggtaatcaaaagcaatccggcagtcttattcgtcgcggccggtaggcgacaatgacgattgctgtatagtgatgatatacagcgcggcgaagaggtggtatagatggttattatctgttctcttcgccttaataatagtatatttcagtccacttgtcaatatgtcaagaagatattttttataatatcaacaaatatatttataattttttgttgattttttatatagcaaaaatatagggaaagggtgagccaccgctcaccctttttccttaccccaaacttcttaaagtatccatcgtatccagtgtcttcattcctcctcccgacttccccgagccgccgctcttatgactctttccgctcttcttgccggaacttgccgccacagccgcctgtgccgccgaaatcgtctcggaagtgccctcgccataaccgggaatataatttctcgggtcaacatacttgccgtccttgaccacctggaaatccagatgcgggccggtagagataccggtcgaaccaacctgaccgatctgctgaccggcctttacttcgtcaccgatgttcaggttggcattgctgccgtcaaccatgtggtgatatgccatagtaataccatttccgcagtcaaccgtaaccgatacgccgtatccctcatactcgtctttgccgtagccgtatttattcattccaacgattttgccactcatagcagcctttaccggtgttccctgcggtgcggcaatgtcaattgctttgtgattgttcgatgcacctgtagtcggcgcagtgcgccagccgaacccgtcggacagcgtaccgccatccaccggatttactgctttgttctcgcccttctgatacttcgttacggttgcaccgccccacggattgctctttgtcgattccttgccatatgccgcctgccacaaataagccttctggctatccgtcaggccgggcaccaacttaacagcctgcgtgatttcctcgttcttagcgttgccgccatccgaattgataagcgaaagcgccgtctggaacagtgcataggtgcccggctcaataccggcctcctttgccatgtaagccttggccttccagccggaaagctccttgcccgcgctgattgcctgctcatactcgttgcagtacgcccgcagcttgctcttttcgatgtcgttaagcgacttgtaataactgttgtctgtcagcgacttctcatactccgaaacgtggaatacatcattctttgccgtgtcgttgtaggtgttcatgagtacggatttctgttcatccgtcaggttcgtgtagctgttcagaatattagccacatttgcggcatgatccgcgccagtacccttgaattccgcttcatacgccgcaacatccgacttaaaccgcacataatcgcttgcatttaccttgcccttaacctcatcgttccacgtctcacgcgccttttcgctcatggaagaaacaagcaggtaatccgcaagggtctgcttctcgccgtccgtcaggctgctgtcctgccggatggcatccaataccataccgcgtgcctcgtccgccgtgtgcagcttctcgccgttttcgtccgtgccctcggtcaattccttcagcgtattgtcatacttggcaaatgtgcttactgcaagaccggcgtctgccgccttgtgagccgcgccctgcatcttcttgcgtacctcggtgctgatctcgaacgaagtccggtcggagtaatccgcagccgagccgcccactgtattaacgatgatatcgcggtcgatggcggttttctggctctgcgtcagcttgtcgttctcaaacagcatgcggcgctttttctcgccttcgttgtcaagaagctgaccgttctcatccgtgtcggactgcacgtcatgcagcgccataatcgcatcgtaaatgtttttgcgtgcttcctggtcgttgtctgcacgctttgcaagcgtatcaaacaccttagtctcctccgcattcaaggtttcatagccgctctcgcgccatgcgcgggcctcatcgctagaactcttgccgaacagcagtgcctgtgcccagtctgccggtttctgtccgtaggtcgggaactgcaggattttctcgcccttcttgtcatacgagtagctgccgcccgcaaacatagttgccgcgccctccacggtctttttcgcctgcaggccgccgaacggcagcaggaagccgtaaagcggcttgctcagctccttaatcactgccatgctgcgtgcatcctcgccttgcgcagtcgcaatattggcgatactcggaataaccgactgaatcggcagacgagagttgcctgcacctaccaacgatccgagcggaccggaaacaaacggaatattagatgcaatatcctgtgcggttgctgttacattgtcccatgccgtttccgacttttccgcacggaaatcatcctcgtcaataccgtctcccatcatttcgcccagcagatcaaagatgttcggcagtgcgtagccggtcaggcggcctgcaaagtcgttcaccatctcgattgggtcgaacgcaccgcgcgaaccggtcagcttttcgcgtgcatcgttgaacaggtgggacataacgaatacctgcagcagcgccgccgctgtgctggccgcgatctgcgccttgctcttgccctgtacccgcaggttgtgcggaatatcgctgaacaggtggtcgtactggttcataacctccagctggaacatggtgaacgccttgatgagcggcgacttggactccatgataaccggctttgcacctcttgcgcggtcgccgatcagtcccgccgcccagcggtcagcctcctgcagcgccgcctcggtgctcatatgccgcttttccacattgtccagatagcgtgcgcgcaccatcacctcgctggatagattgtcgattgcgttcatcgtccacccagccgcatccgaggctttctgcagtttcgtcttgataacacgttcgctgccccggcgattggtcaggaagtccgaatcctcatgaaatgccggattttttttggcgaggtctgcgccgtaatccagcattgcgcgcatcatgctcgaataacgtacctcgcccgaaccctgggccagcggaataaagttagagatcgcggtcgagaggttgccgcctaccatgtttgccgcaaccttgccctcaacatcgctcatggcgcggtacaggccgcgcccgaacatctgttccgcgctgcggtctgtgcgggatttcttgcccgccagaatgttggtgtactccgcgatccagctcgggaagctcggcagcgtgccggagttgcgttcccaaatcttgctgatcttctgttccttgtcctcaatattgatatccgggtctttgcgaatggcttcgagttccgcacggctgccttcatcgctgtatttgccgcgaatggcgtcctccagtacacgcaagttctgaatatcatccgtgtggaaaattgcgttgctcgcgccgctgatatagttatccatcgccttaaatgcgtcaaactcggtgttgatgccctcgcgctggttgtagaatccggcgtactgtctgcccggtctgcggtcttcggttcgtcccgcaatctcggtcggcagctcgtccaccatggtttccacgcccaccttacgcagaatgcggttgtaccacttgccttccttggtcggtgtaaggctcgggatgtatttctgccgaaattccagcggcgcatagccgttgcgcacaccggcctcgctgacctgtggatgcatttcgcttgtcatttcatacagcttctgcatggcactctctgcctgcttaaaatggattttgctcttgttctccttcacataatccgcaagctgcttctgcatggcttcgttcttcggagagagttctgcacggttcttcatgtgcatatacacactgtcctcgtgcgacaggccctccataatgcctttcagccgttcgcgctgggtattctcccagcggatagcctccgcgtcatgcttgagtaccggtgcgaaatatgcctgataaatagcctctgtttcggcggtatcgcccataaccttgcgcagcacgcgctccggcgtgtggatctgcaaaccgaggttgccgcgtgaatccttccagttgtccgaatccttgataagttcggttgcgcgtctcaggcgtgcatcatcaaggccgcgctgaaatgcgtaatacggctgcatatcctcgttgtactgccgcatagcgcgggcgtaggtctctaccagttcgtagcggtggctgtccatctcggttacagggccgcgtcccgccgccatgcgttccgcatttaccagttcggcatcgctcaaatgccagccattgcgcaggttggttaaaaagcggcgttcactttccaggctgttcacaaggtcgattgcaatatcctcttgcgtatggtcaatgtagctgtccgcgtctgaagctgtcgcgcgggtcgttgcgcgttccaacgcatggcggcttgccacgcgttctgcgcgctcctgtgcctcatatacgcgctgcataatgtcacggttcttgccgttggtgatgcgatcaaggcgttcttgctgttctgccgccgcctgttcctctcttgcctgccgtaccctctccccctcagccttcgcccgcgcctccatcaccgcctgttccggcgtcttgccgtactgcatcgcgttagtcagcggaacattttcagtggatgtattgccattctccgcattttgggatatactgttatcataaaccattcgagtattttgagcgccacgcccaaagggggcggaggaagagcccgcactgctcggatggtttcttttttgcataaatccaatgctgtacgcggtatccgtatcgccattgaacgacccattcgcattgacgcccgccgagaacttctcgccctcagccttcgcccgcgcctccatcaccgcctgttccggcgtcttgccgtactgcatcgcctcggagagcggaatattggtgtcggaagtattgctatttcctacattctggcgtatactattatcaacggaagggatatcacttccgtcaggcgaaactgtgtcgctggggtagcccattttggtcccagtcatgaacgacatggtttcgcctttttcatttgtcaaaactacttcatgcagataatatttgcttgccatatcggcattatcatatttctttacgataacgcccatatcgtacacctgctcaccgatttgcacctgaccgccaaaggttacggtatcatatcggcgacccttccagttgctctgcgtgtcaatgattgctccgttttcaataacttccggaaccgccgagaatgcaatcgctttgttgcgtcccatgccatgagaaatgctgtcacgcgcaccgcttcgagttaaggtgacatcgccaaaacctgcgcgaaaaaccttgttgccaatggaattgaagaaatccgttacacggtcaacgagttttttcttgctacctgcaaattcttcgtctttcagaaccgctaaaacgcccgtctgtgcaatcgtatcatgattcgaagaaatcacctcgttcagcgtcctgtgctgtgctgcatcagcctgctgtaccgtagccttatcatacaccccgccagtctctgcctgctgttcctccgcgaaatgctttgcaagctggctctgcagcgcgtattcttcttccggtgtccggtagctactttccgcacgctgttcggtctccgtaccgaggcgaggcttaatctggccgtcctgccatgcgtccacctgtccagtgcgctggttgaggtattccgccgcctgcgcgcgctgtgcaaggctcatgcggttattgagatcagcgtcataattcgcggtaagctccgcattctgtgcaacctgctgcgtcataaggccggaaatcttgtcggccatcttgttctgcgcggtctgcaccgcacgttcccgaataggcccttccgccagcctaagcgccgcctgcagctcgctgtcgagctgtacaagctgctgcacctgattgtaatcgtatgcatcagcggcattcatacgctccgtatctgttgccgctctcgaaccgactgcacccgccgtgccaaacaccaagccgccgaacgcgccgcctgcggcgctctgtgtcagctccgcaagggaaaactttgcgtccggatcgtttgccgccagatccgcaacatagttgaggaaatagcttgcgctttcctctgttgcctcctcacccatctggatgaggatatttttcacggcattcacgccgccggagtgcaaaatcttgctcatctggccgagcggcagtctttcggttgccgcctcgatcgcacccgaggtcaaccctcgcgtcagcgactcccgcgcgccgatcccgcgctcattcagttcaaacgagcgctgacctgcagcctggccgcccatcatgatcgagccgaccgccggaccgacgaccggaatcgcacttgccgccatcaccggcgcattgcccgcaagggaaatgccctgttcggtcagccagcgcggcgcaggcgctaaaccggccgcggcgtttgcctgtgcctcgttcgcctcgcgcagcatgcgctgagaccatttgttcggatctacgcctttgtttacggtcagctcgttcttgcgcttgcggacctcctgcagctgatcgtacaccgcttgatagtctgccggaaccgagccgtccgctgctgtgctgttcatgccctgcagggtgagttcaagtgtctgctcctgttcctcaagctggcggtattcctcgttctggcggctctcctccacgttcgcgctcacctgacgcgaggtgtccacgagggacggcagcgaagcgatccaccgcttgccgacagcctccatgctgttgccgagacggtccgccgcgtgccgcaggtcaatgttttcctgcacataggcaagcgtgttttcgtccgcaccggcggctttcagccggttcatgatatcatccgcgttgtcgcgcggctgataggtaaggccgtaccgcttcataatgcggctcatctcgtccgaaagctcctgacgtgccctgtcgcggctctgtgtgtcctcgctgctccatgtctcatccgaacggttaaacaggtcatgcatcgtcttgtgtgcattgtagccggtctggccgctgaaatagtcctcatccagtccctgcgccgcctgcatggcagtcgggtagacggttgccttgtctgtcttacccatcacgccggaagtatgcagcagctgtgtagcctgattcagccgttcggtcggcgtgctgccgtaggccatgcgcacgccggcagtcatttcgtggccgtacttatcaaaagaggcaccggtctgcggattgtactcgtatcccagcttgcgccgcaaggcgtcgttctgcgcgtgcagctgtgccttcctgttcggatcgctggtcttgtgccagtccatggagttcttgaggaactgcgtcagcgtcgggttgccgtctccgctgctcttagtggctgtagatacgttctgccgcggattgcgccgctgctctgccgccttctttgccgaaaaaagctgattctgctgacttgccgcatacggctgacttcttgtcacgctgccgccggtcagataggtgcttgtaggctgccgtacattgttctgttgcgtgttccggctgcctgtgccagaaaggccctgccgtgtgttcccgcgctgctgaaaagcagtgttccgctgctgatttgctgcatacggctgacttcttgtcgtgctgccgccggtcagataagtgcttgcaggccgctgtgcattctggtgtgcctgcacgcgctgctgctctctgttgcgcgccgccgttgcacggcggctgttgtcctgctttgccggcttctgcggcacaacctgcggcaccttcagcagcgcggacgttttgttcttgtttttcttcttctcgtaatcgctgtaaaaactcatatgaacctcctaaagagagaaggcggcgaaaatcgccgccttctggcgtagttaaagctggttaagctgccactgcgagtatttgttggaaaggttctgaccggtcgtttcggcccgcatcttctcaatctgcgcctgaatatactccatctgcttctgcgctgtttcgcggtcgattttaccgttgagcttgtcctcttccagctgttcaagctgcatctgcagctgccgcatggcaagcgtctgcgtgccgttgtaagtacccgtctgctcggcctggctgaggccgaactgctgcccccactgcatagcggagataatgctgtttacgttgtccagctgcttgcccgcaacctccttgtagagatccgccagcgcgttggctttctgaatatcgccgtttaagcgcgcctgcgtaatcgcgcgttcaatctcagcgagggcctcggtagcggtcgtcgcgttgctgttcagcgcgttctgataggtgttgcctgccgagatctgactggattcggtgttgccggtcgtcagcaggccctgtgccgccagattttcagccatggagccgttcggattgatcgccgtcatgtacgccttctcagccgcagcgttgttcgcctcggtgttcttgccgatggtgtacttctgggcgttcagattagcgaccgccgaatccacactcgcctgcaaagcactctgctgtgcctgtgcggcatcgttcatcttcttctcgtagtcctgaaagccctgattgtactgattgctcatcagcgtgccgagattcgcaccggagataccgccgctcgcaaggtaatccgagccgtccgcaccgccggagtagccccagctcttgcgcagcgcctcggcttcctcgtgcgccttcttcatgcctgctgtgtcaccaatcgccttagcctcatcgtactttctcttaagcacgtcaagctgtgcgctctggtttgcgtcgttgttgcggatagtcgcgtcattgtgcgtgccgctcggtgtatatgtacctccagacgagccgctgcccgaagtcttgccggaggacgagccgccggagccggtgccggaagcgccgccgtaagtgaacgtctggccgcccttgctgatcgtggtcgtgccgtcgctgttcttcttccaggtcgagccgtccgagccggtcatggtcgagcctgcagcagcactcgaaacaaaattcttgcccttgtccgagccgatgctgtacgagccgttcttgccgctcgcactcagcgatccgctcgaaccggaagaacccgacgagctgcccgaggacgatccgccggagctgctcttgcttgcctttgccgctgcagctgccgccttaacagcgcccgccagcatagaacccagtcccatttacttcacaccctttccgagcagacctaaacgctgtaaaatcaccgcaagctgttcacgcgtcagcggactctgcggcttggtaccgtccataataccggcgtctgtcgccgcctgccaggcctcggcagaatacggatgcggcttctggttggccttttccgcctgatagcgttcttcatgtgccgcaaattccttgtctgtcatcttggtttcctccttctttgccgtggttttcgagttgtacttctgcacctctgcccacgggaactttgttcccggacaatccgtgctgtttacgtccttgtgccgtaacagctttgcaccgggtatttcgccatcattgtacggataaggtctttcagcgcgtccagctgtgccgcaggcatggtctctctcatgtagctgccctcacagcagatgccgatcgcgcggctgttgtgcccctgcgcgtgcgcgccgaccgcccattccgggcggcctctgtaaaccttgccgtccttgcggatgtagaaatggtagccgatgccggtccatccgcgttccaggtgccagcgattgacctcctccacgctcgcgcggcttgcttctgcgtggtgcagaataatctcatccgtgctgttccggcgcttgaagctgccgtttgtcggcagattggtctcgatgatctgcatgctttactcctccttgttgggcttgtcatagccgagcgcggtcttgctgtccccgatgcccgccgtggtggggtccacaaacacgctgaggatcgcaaggcacatggtaacaagctgcaccggattgctcagcaccgccttgatgccgtccagcaccgcgctccacgaggtaaacgtcatagggtctacaccaatggccgtgattgccacggccgcaacgccaacccaaaaccacggattcttaaatctaacaggtacattaaccttcatgcagaacttcctccttttctaaatcatcaatgcggtggttggccacacggatacgctcatccagtacactgaactccttttccagttcatacgtccggctgatgaggttgttgtgcttctccaccttcttctccagctgctcaatgcggtagttggtcaggttgctcgacagcgcaatgccgccgagcgttccaacgagcgtaccgaccagcgacagcgccgctgtaatcacttctgccggcataatcaaatacccagcaggctcttgtccagctttacgccaacgtcgccctcgtacttgtcgatggtcgcaaaattcttgatgtagatgttgttcttatacataaatatctctcctttgcgaaatctccactttaaactgtaacgtatcgttatttgaactctgactgctgtccttgcggtacttcacatcaatgaagtgatcgcctttcgctacattggtatacgcatacgtctgcaccgaagcggacgaagagcccttgaagctcttcgccacattcgttgatacgtctgaatatccggtgtccatcgccgcgtcaagcacaccgagcagaccaaaatcgtagttcgattccgcgtagttgatacacttgaacatcaccgtgcaggctttcgccgcgtgaatgttgacacggcagacagccgccgagttgtccacgcccttgttattgctctcatagtagccgttcgagttcagcgcaaatccataggacgcgccgctgatcgcaaatacttcaaaagagttctcgtccggcttcttcatcagcaaattgtaaatcacacaatcacctcacgaaaaattgaccggcgtaatggtcacatacacggtgattgccgctgtcggaacggtcttgcactggaacgtcagcgttcccgcgccctgaccggtgcagagaataccggcgtcgttgtacgcagacaaggaagccgccgcaggcatcgggagaatctgctgtgcggtctcatccgctacaacgtccgcgcaattcaccgtctgcttcttcgtcgagctgttccagccggaagcggtaagcgtaaccttgtgggcaacaggtgctttcgctaaaccggcaccgcaaagttgctccacaatggagggcgatgcatcagcgtacgccgctttgttgctttcgtctgccaccgcaacaaacttgccgttgccgtagcagacagactgccagccttccgaccccggcagcgttgccgccgtccatgtgataccatcggcactgtacaccgctttgctgccgccgtatgctaccgcaacaaacttgccgttgccgtagcagacagactgccagccttccgacaccggcagctttgccgctgtccatgtgataccatcggcactgtacaccgctttgctgccgccgtatgctaccgcaaaaaacttgccgttgccgtagcagacagactgccagctttccgaactcggcagtgtagctgccgtccatgtgataccatcggcactgtacaccgctttgctgccgccgtatgctaccgcaacaaacttgccgttgccgtagcagacagactcccagtcttccgaccccggcagcgttgccgctgtccatgtgataccatcggcactgtacgccgctttgctgccgccgtatgttaccgcaacaaacttgccgttgccgtagcagacagactgccagctttccgaactcggcagtgtagctgccgtccatgtgataccatcgacactgtacgccgctttgttgctgtttgttgctaccgcaacgaactcgtcattgccgtagcagacagaccaccagctttccgaactcggcagtgtagctgccgtccatgtgataccatcgacactgtacgccgctttgttgctgtttgttgctaccgcaacgaactcgtcattgccgtagcagacagactgccagatttccgaactcggcagtgtagctgcctcaaacgccagcccaaactgtacattgcttaaatccttcgccgcagcgccagcctgatcggctgtcacattatgcggattattcttatccgctgtatgcgttttcagatttgcttgtacgttagccgccgcgctttttgcagcggctgcagcactgttcactgtctgaaacagcgcactgtgcgcgttctccgccgtattgtgcgtctcaatctgcccgctgacatccggtgtcggaatggcagcgatcttatcatcggtatacgttgccgccgcgctctgcgccgcactcgcctttgcgtccgcatactggaacacatcctgcgccttgccctttgggtcataaacgcttgccagcatatcgcccgcgcccttgccgtctgcgcccttctgcgcgatcagcagccagtacgcggtatcggtcggcgcatgtccggtcgatgcagccgtgcatacataagacgagccgttaaaactgaccttatttccgggtacatacgccttgcccgcgctgtactcctcccacacgttgcgtgctttctcagcggtctgacgggcggtttccgcagcggcgcggctcttttctgcgctcacgcgggcggtctcgttcgtctgacgggtgctttccgtgctttctctctgctgttccgcacttgcgcgtgccttttccgcagattttcttgcgttctcgccgctttcgcgcacagtctccgcagaagcgcggtctgtctcagcagatttccgtgcgttctcgtttgcaatgcgggtatcctcggcagaaacgcggtccgcctcggcatccgctctgccggtctcggcagaaatacgcgccgcttcattctgtgcacggacgctctctgcgttcgccctctggctttctgccgtcacgcgggcagattcggcgttcactctgcctgtctcagcagaaacgcggcttttctctgccgtgtcgcgcttgttctccgcattggcgcgggcgttctctgccgtgtcgcgggcgctttcggcctgctggcgggcggtctcggcggacctgcgggtgctttcctcctgcgcacggtcgtcctcggcggtcatgcgggcggtctcggcagagacgcggccctgctcggcctgctggcgttttgcctcctcgccgctccactcggtcgtggactcctccatatccgcaaacgtctccacaatctcgttgaactgcggagccacgcattcccgcaccagacggtcaaacacacgtttgttctcgtctgccgtgccggtcagcgtgtccggggacgcaataacgcccttttccgcaatctgcgcatcggtaattttgtaatctctaatactcacgcacttctctcctctcccgcctcgatatacttaacgagaatctcataaatgccaaaaccctcgttgagcgcatccgagacgaaaataaactgaatcattttccactttttcttcttcacgcggaactggcggatggagtttgccgaggtctcgaacgtgaagcgctcaaagttgatatcctcaaaggaaagccggtccgcgtaaaactcgcggtacagcctgccgctgtcgcgttccgtacggatatacagatcgactttcgagcgcgcatagcgtttgagatgcaccgccgagcctctctttggcatagtcttgagcatcgcgatattgcccatgctgtccagcttagaagcccattcggcgtggatcggcgcgccgtcgtcattgtacgcgcgcatgaggatctcattctcggccgtcaccatgtcgtcgttaaatttgcaaaccttgccgtctgcggtgccgaaataaagggtctgctgatccgcgcggagcacccgcgccggaatattggtccagtagtaccactcataaccgttatcgctcttgtcctgatttccgtccgccacatacgcgcggccatctacgacaagcacataccacccgcgccaggtggcggccaccgcatccgcaaggccgttttccttggtgagcttcggattgacacgccgactgcggcagaataactgccgcacctgcatgttgttgtagtaggtggtagtcggagcatacacgccgcgtggactcagatataacggatcatcattcaggtttgccgccgagtaccgcgcgatcgcgccgtaacccggcacaccctccttgagtggaaacgccgcaacatcgttgctcacaacgcccgcgtggtgccagatcgtaccttcctggcgattatccttcttgatgataagcagctcgccctgcgctttcagatagcacataatcggaaaatcgctcgaaccaaccacagaatagttaatgtcggggaaatatgtcgggtctgtcaatcccgagaaccactccgtgtttgcatatttgccattaccggaaaagaaaacgcggtcgcccgagccgtccatgccgtaaatggcaaagatggtgcagccgagtatcttcttccggtcctcagtcgtttttgcaaatcggatctcaatgttggacgtgcccgcgttctccgcgccttgggtgcggtctttagtgtcaccgtgcccttttccgcatcaaagctcgccacctcgagtttatcgcccgtaatgtgatatttcgcggtgatggtctgctccttgtcaatgccggtgacatcaagctggaatgtcttgctgctcccgtccccgacaaagcggttgcgtctccacttgcagagcatgtttaccttctcgtaagcctcaccgccgcccgcaggcttgcgctgatagctcgtcagcggacagtacgccgtatcgtccccgacgtgcttcgcgtccttgccgtcatataccagatattccgacccggttaaaatgtacagcttgccgttgaggtaaaagccctgcgagcgtccgccgctcctcaatccggtcaaaagtatctgctgactgtccgggatcggcagataggtgctctcgttcagtcgtaccttatacagcgtatcgcccgcatggacgatcatcgtgcggcctgtctcggtcgtggcctcatacggaaaaatacccgcaatcggcttgtcactgccgaggtcaacaactgtgcgccagccccaccggcgttcgggcgcgccgccctcgtccgcgataacattcaccgcacgcggacttctgccgtcgtcaatctgcgtctcatccgtggagtagtccaccccacgaaaccgcttgtaactctttctgccgatggtcggcgtggaaaagtcaggaaccgtcatggttttcattcttcgtcaccgtccccatatcccagcaccgcaggcgcggcttcctcaagcgcttcgacaaaatagttgcgttcgagcaccatctgagcctgcttgtcctcctcgtcgatcatcagcgccgaggcgaggccgtgcggcagtgcgccgcgcgtgatccggtcgtcccagtcgataaccgtatcgtctattgcattgatttccggcgcgcttgcgagttcctcgcgtccgtctgcggcgcggatagcgttctcatacggcagcgcctcgatcagcagccgctcaagcaaaaacggcgaatacgtgtcatagtccgtatcgccgcccttgctcgtaaacagaatggcggctgccagatcgaatattttcctaactgttgccattctttcctcctaaagaaatgcagggcaggcgtcagcccgccctgcggtaaatcacttatccgtagcctccgccacatccgaggtcagcttgccgcccttgccgaacgcaacgaccttgatggtctcgcccgccttggtggcaaccgtgccgccggtggcaaccgtcttgcggtttgccgaaaaacgcgggtcagagccgtccagggtgtaccaaatttcgtcagcacctgccgccgtaacggtcgcactgtgcgaagcaatcgctacggtgcacgcctgcttgcttgcggtcttaccgatgataacaaccgcgtctgccttgcttgccagcacgaacaggtcataggtctggcggccttcgatcagcgcaccggaaatgccaggcgggtcctgatgcaccttggtgtcattgatgcggtacgggaacgccgctgcactctcctgcatggcgatcatgtaaacatctgccgggaacatgttagatggaaccttaaccacggtaaagcctgcaatctggccaaccgtgccggtcggcagctgcttgcctgccagggaatccaggcccttccactcgtcggacaggatgatcttcgggtaatccttcgcgcggacaaacagcacgcggccattctccggcacgagcttctcatccatgtaggtagccgcatcgtaaaccatgccaacgatggtgtcctttgccggctcagcggtcacgccggaaacgtggccgtacttggcaagctgggagaaaccgtacttgtcaccggtcggtacgcagcgctctgcgatctgctgacgcagccactggccgctcttgttggaaattgcctgctcggacgcatcgcccttgtcaacaacgccgttaaaagacttgtcctgcgtcatggtgtactcaacaacggtgtcctgtacgtccttcgcctcgccgtaacggctggtgccgctgcgggtataatccacaaccggcacggtgttcagcatgtaaacacggcaggactttgcgccgatcatctccacgttcgccttgcagtggcttttcagataactgtcatgggtgtatgccttctcgatctgtgcggaatatttggtagtaagattgattgccattgattatgtcactcctttacagcccgaggaagcccttgaggaacggatcgctcgtatcgtttccgtttcctgccacacttccggggcttgtctgtctgtttgtctgatttttctctgcgatcctgaccgcctgctgattcagttcagcctgatagcgccagtgcgcggcaacgggcgtcatgccctcgctgttgacaagctccatcacgcgcggcggaatatcctccggcttgtgtacgtctgcgattgtctcgtattcgtcccacgccttgatatttgcctcctgccgtgcctgttcaacggtctgatcaattctctgctgcatggcggtaagctccgcccgctgctgttcggcagcctgtgcttcggctgcccgccgggaagccatgcggccctcggcgattgctttgagcgccgcgtccggtgtatccggaaactccgtgcggcactgctccatctcagccgagagaagctgctcattgcgtgctccctcgagctgttcgagatactgctgccgattcatgccggcggcctcggcgtactgatccagtaaccggaactcacgttcgcccttggcgtcgtagttcatacccttctgcaagagttcgaccggattcgcgccgagtgcgctctgcagcgcatttactgcctcggcaggcagtagaatttcagtgtccttccacttgaagggtaccgtctgcggtgcagcagcctgtgccgcatcgctgtttgcgccgtcctccgacggctgattctccggttcttcctgctgctcttcggcgcgctggtcttccgcaccgtcctgcacagtttcctctgcaccctcggcggcggtctgctggtcttccaaaccgtcattgccttcgagtgccgcgagaaaatcgtcgccgttaaaaccgtccatgtccgcaccggaatcggaagtattgccgtcctcggcaaaatactgtaaaccgataccctcgcggatctcgcttccgtccatgtgattgctggtcttccaatccatttagacaatcctcctatatgcaaaagactttcgtctcattgccgtgtgtttatcgtgtgtttatcgtgcgttcctgcactccggcggacgcaccgccgttccgtaagcagtgcacccacccgttttccataacgctacatcaaaagaggtgaacccggacgagggtgatatggcaaaaacgcccacgcccgccgcagtgcaggaaaatattaagttgagtgcggtggccggacttgaaccagcaccatacatacgttttagcattggtgactggccgttgcatctacgcatgacgtatcgtcaatgtaacaccccttagaaggaagctgctctaccgttgagctacaccgcacatatcgtccgagactctgacgggcaggcaaggccaaatactcgcaggccttgccgccgccatacaatagaaaggagaaaataggtatggccgttccgtgcaatgcaggctcggtcgttgggcattactgcccgtcacagtctcggactcagttgtattccggcgctcggacggacgccctcgacccgaacgagggtgcccgccatcagaaaggaataaggggaatcaatggggcgggtgaggtcagctcccgcccgtccgagcgccggaacagaaaaatcaataatcaggttcgagaatcggaacgccgtactgcacagcgcattcgcgctcaatcatgcagccgcgtgcgtccttccaacccttagcgaaataaacgagatccgcatctgccataagccggatagactcagccagaaaccaaagtggctttgcgtcgtgcggtgcatccttaaaaaaggagtcgatgatttcgacaggctcaccgatatattcagtcgcttcgcggatagcacgctcacgcgcgcgttcaatctcatcgttggtcttgtccttcatcggctgagaaataaataactttttcatgccgtacctccctcaaaaccggaacggtctgtccgttcccttcttggtgaacttcgccttctgtgtgttcagctcatcctgaagcgccgcaaacatgctttcaacctgcttatctgtgtacgcatacgagcttgccgccagatggccgatcaggctgatcgccttgcacgcacgcgaaacgcgcggctctgccagccttacaaagcgctccgccttgctctcattcgtgttatccattcattaaacctccctgctgtaatgcctgctgcatgctcgcctgctgctgcacgcgctttgcagcctcgaccaaaccttcctgatcctttacgctgccttccggcatgcggctgaggaactcgaccatattcggcatcacgcccgcggactgcaagttgttgagtgtcgtcacctgcaaaatccgcgaccagtagcttgcctcgccgatatgaatattgaggtccagcgcctctaccggaatcgcgccgaagtcgaacatctccacgcgggtctgctcctgcgtctcgccggtctcgtccgtcacctcgtcggtgatcttgacctgacgcatgccgtaataggcgtgcatcatgtcgatcagcacccgctcgtagtcctcaacaaactggtaatacgcgatcttggtcagcgcaagcggcgccgcgttcgcggtctgtaccgctacaatcgcactgctgttctccgggttcttgacgttgccgagcgcggcgtcattcgcgccggcaacacttttgagggcgtccgtcatggtggacgtaatgcccgtggcctcggtcggaatcggcatcgagcctgcaacgccggtcagcgcgtccttcacatcgcctgtcacgccgatggaagtcgcgtccggatcccaccccttcgggaacttgttccggttgtatatcaatttcggcatggcgttattcctgagcatcagcgccaacgccgtccactgcttgttgatctcaatctgcgtattgatgagcggtttgatctccatcacgccgtgatagcagttctttctcggcttccagctgagataagccaccggatacagcgtcatttcggtcgccacgtcctgttcgatgagtacgcgcccgcaggagcggcagtaatgtaccctgccgtcctcgcttttccagaaccgcacaagctcattgccgaggctgtcgctgttattctgctcgtcatcacccttgtacaggccgtcggactcgccctcaatggtctcccattccttgcagccgagccgcttcgcgtccttgcggatttccgtcaccggacggcggcgcacaatgataaggtacggctgctcctgcacgttcgcattagaaggatttccgaacagaatattcgtgttcattacctgttcggcgcagatttcgccctgcaccccgcctaaaccggactgcttgcttgcgtcaaagtaaaaatacaacgccgcgtcaccgtccacgcaggcgtcacgcaagaccatgtggtgcttacttttcagcttggtacgctccaccacgcggtcaatgctctgctcaaggattttcgccgcatactcggcctgctcatccggaaggaacggctcaacctcctgatccacatcgttggagacgatctgcgccaccttgtaatgcacgatcggatccagtacgttcatcgtgatcggacgcaagttcttgctcttgagcccttcccactgctttccttccacaaagttctcgcactgcttgacgttctcgtacaacccgatacctgtgttgtactgcacgcccttttcgtactcggcctgcaccctgtcagccgtgagcgtggttttctgctcattcatcgctcaaatcctcctgcccgtgggcggtgccgtcatagcggaacagattgttcacctcacgcataatgcggccctcggtgcttaggcggtacgcctgttccttgtgaaattcctctttccagtgctccgcggcctcgcgctccgcgatcagcgcctcctccagcctgcggcgctcctttttgagtgcgtccacttcggcgcgggtggaatacagattgttgtagctcaccctatgcgccgcgctcacctcttccaacttcacggtggcggtctgcagctcctgccgcagacggcaggccgtgtcctcactctcccgcagggcggtctccaccttggtaatgcggtccgcaagctgcatgcgcgccgcctcctcggtgtgcaggcgttcctccatcgtccgcgcagtcagctgaaaggattccgcttccacggttttttgccgcaaatcctcgcccaagcgcttggcgtttcgggtctgcacagcagccagaaaagcacacatcgccgcaacgacactaatagctaaatacatttcccatttcctcctctgtagtcagttcgttgtactctctgggttcgctcgccgcgatcggacggccggccacaaagtaccgcagcatgtccgccgggtgggtgtactcgtgcggatcgtttgccacgtcgtccgggtgcttctcatcgtgcagcagcatcggcaggctcttgatggtctgcgtgcagttggagcagatcatcaaactcggcttgccggtgtccttgcgtaccttcaggtattccttcaggtcgagccagccgagtacgcggtcgtttttcgccttttccagatacacaccgcattctgcaaagcggtctgccgcgctgcgtccggtgtcctgccgcctgttccagaggtcaggcggcgcaaaggtgatcgcatcgcgttccaactcgtccgagcgctccaggatggcgttagccgcgtcagataatataagtccatcgtgtccttctcccaaatccttgccctcgcagaattccttgtaaagatacgccgtgccctgctcatccacggcaaaccagccgacagcaagcatatcaaagccgtagtcaagcgccttgtaccgcgtccagtgctccggaattggaaaagcctcacagacgtgcgtctcgcgccggaactcggggaaatactgtccttcgaatacatcccagtcaccgtacagcatcgcccgcttgcggtcttcgggcagattctcgagcgcgttcacataatccgggctgttgtgcatcagcgccttgttgtcgtacacattcgcctgaataaagacgtagtgttccggcttctcggtctttttgtactcccggtcgataaacagccgcttgaaccaggcatgaccgacgccgccggggttgcaggtgaagtacatcctcggtgggaagtgctccgccatcaggccggaagaacggttggattccgtcatagtggtaaacacgttctctgggaactgcgtacactcctccagaaagataacgtcatacgcctgaccctgatactgcagcaggtcactgtcatgccggcagtagccaaacttgagccgcgccccgttcggaaagataaacgccttgtctgtgccgttgtacttggcaacgccgtgcagctcacgcatcgcgggcagcagatggttttctttcagttccgggtacgtccggcgcatgaaaagcacctgaatgccgtcatagcgcaggcagagcagctcggccttcatgcgtgcaacgtagcttttcccgccgcctcgcgcaccgccgtaagcgatataccgcgcccgcgacagcaaaaaatccttctgcttggggtacggactggaaaacgtcagccgattcattccgcaaacgcctcctcatccggagacgcgaacgtgatctgcgcgcctgcgctctcgccctcgttcaaatgcgcctcaagcgcttcctgccgctccatcatatccttgagcgtgccggacagctcgcgcagggtggtgccggtgtagttcgtcacgatcttgccgagcagctcgacctgagccggatccagcgagatacaaccgtccttcgcagccttgcggacaatcgcaagcccttcgtccagatccttcatctcgctgagcgtcgcggcagccttgcggccgagcgagcgaacaacatcgtccacgaccttgttgcaccgcttgatctgcgtgcggcggatctcgcgccgggcggcaataccgtcctcgtctccctcgttctgggtgtgcacccagtccgcgagcgtcgatttcggaatgcgcagccggcaggcggcatttgtgatcgagacgccgctcgccacgagcgcaagcgcctcctctttgaacttctggtcatacttactcccgcgctgctgcatccaatcacctcccgcgcgtgtcttgttttgctgaatacaagtataatcggaaaaatcggaaaaaacggaaaactttactccggcagaaaaaagcgcccgagcgcgtccgtcagaacgcgcaggagcgcataaaaagggcaaccctcttggattgccctttgtcgatttgtgtgttatactgttgttgcggacgcagccatgttaacgctatgtgcggttattcccaccttacccaacacgaggggaggtgatgctatgatggttacattttctgatttatttcagttttgtctccttctcatagcttttgctgaactgattctcaaaatcagcaaaagaaaatgaccgccctcctccaagattgcggtcattttcaatgacataaccaatcgggagtaaccgttcatggctgcgtcccttttgtgcccttattttacacccaaaccaccatgtttgtcaacgccgccgcagagcggtattttttattcctgctcccgcaccatgcggtaaaatgtactctttttcagtccgagccggtccatcgcctgcacggccgtgatgctcccacttttccacaatcctgtgactaactcccactcagcgggcagctcagtcttttttcgtccaagctgccgcccctgctttttcgcctcagcgatgccctcggcctgccgctggcgtatggtcaggcgctcctgctctgcgatcgttgcgagcacctcgatcataatgttgtttactatttcgcagatccactcctgaccttttggaaagtcagccatcgtgctcggcaggtcgatgatcttcacgcgcacacccatcgccttgtaatattccagttcttgtttgacctgctgcttgttgcgcccgagccgatcaagactcttgacgatgagcgtgtcgcccggccgcagcagtgcctcgcgcagatactggtatcccgggcggttgaagtccttgccgctctccttgtcggtgatgatgtcgcgctcatcggcaatgtactgccgcagcgctgcaatctgacggtcgagattctgttcgcgcgtgctgacccgcgcatatccgtatactttttccatatttgacctcctgcctgcttaatgcgtctcaaaatgtcctgttgtctcgcggaacgtccgtaaatcaaaagacaagccttttcgcacgccataccgataaaaataccgccgtcaatctgccgtgcgaaaaggaacaccttttgacacggctatttcgaccataatttcccgaccagcttcctcggcccgctctcatcggcataccccatccgccgggcgcactcgctccagcttttgccgtccaggtaccgcagccgcagggcgcgccgggtcatggagtctgaaacgttgtcgatccactgccgcaccgtgtcgcgctcatcctggcactcagcctcaatggcctgcagccgatcgcgtgccgcgtccagtgcatcccggccaaacagacaaccgatgccgtaagtctcctcgatccgcttgtggtgccgcgcctcgcgcgcaaaccgttctctttcttcttccagttcacagaccaggctttccacctgtttcaatctgtcttttgtcattgtgccgtgctgcacctcctgccgcgcagatttcccgccttgcttccgtcaccgttacgcgcttccgcgcgctccgtccattgatagagtacaaacagtaatgtgattacaccctgtattcatttgtccgaacctctccgataaaccgcaggggaattgttagaccccctacaaggctgtcaggcggacccggccgccgatatcttaaacttttctttgccgtctcctgcgcagccgttcccacggatcgggagcagccttgcgccgctgtatctgccaccatgcgtcaaacgccgcctgattgtaaatgcggccgaccataacctcatacctgccgaactcattcgcgttctgcacatgttcgatgatcttcacgccgggcggcacttcggcctcctcctcctcgcccagtctgagccgaaccggctctgcaggcggggtcaaattgcggctggtggagtaccggcgggcgcccttgcccttgtggctgtcctccttgagcagatagatggcggtgtcctcaaaaaagtccgcgccctcgcgcagagtccgcacatcggccagaccggaagcccagcaatcacgcaccacctcggccagctgcacgccgtgcgcgccgctgaggatcaggtgatggtgcagccgcaccggctcaccgtccatgtcatgttcttccgttaccgctatgtatttgtaggtaaggccaatcttggcatacgcctttttcatcttcgcatgaaacttttcgagtgcacgcgccctggaagcctccggcgcataggtcaggcaaacaaacagatcccggccgctcacaaaattcgcgttgatcagctgcatcagcctccacttgcgctgccgccggttgatctcctgcttggccttctcggttgtccgccgccgtccggccctctgcctgggcgacatgcccggcatcgtgcccatggaatataaacacatctgatagagcgcaccattgcactcctgtttttgataaatcataaatcacctcttgcggccgactcctgcatctgcgccgcaacatatatagtaagtcggatgaagccagcccttcacgggctggctttctcttttccgtttttcatcttccaaatcttccgcgcctcagccacgaaaaccttgcggtaatcgcgctcatacgcgccgaagccataagtaaccacagccgccgtcatgcagttgatcagctcgtccgctgtcagaccgtgctcggcagcgttccggataaactcacgcatttcattatccggcggcagtccaaacgatcggctgtaatgcgaatcagccaggtgtgccgtctctgtcgggctgcgcattactcatttcctcccgaatccgcttgagtgttttctggataccggcgtgccgcgccaccttgaaatcggtttccagtccaaaaagctgaataatctgctcagtgacattgaccacatcagccagttctccggcaaggtgttccagtctcgcggtcaaatctcgtttcttgccgccctgctcgtgatagctgagcagcatcagtacctcgcttgccgcgctcgtagcctcgcccagttcttctatcagcttgcagacctgcttttcctcgccgtaataatgggcgatctgcatcagctttgccgctctctttgcattcatgtatcagttcctcctaatcaatcttgagtttcccgtaatagcgaatatccatccggctgacgtcctccgcccgcagccgcagcttttcaaaggcgtaatcgtcgtctacctctgcccgcattttcgcaagctcgtccgagttctcctgaaacgcctcgaaaaacttctgcaggcgctccggaccgaagccgtaagcatcgtgcaggctgaccgccatcagccagagataccgctgcatgctctgctcgacgttcaaaagcgccgcctcatccatcgccagttgcaagcgatcccgccgcgccttgagcagatcggcgtaattcatgccccgcggcttgcctttgcctttcttcttcacgccagacgatccccttccttgcgcagccagtccgcaatcatctttgcaaacttctcgcaggcggcctcatcgcttgcctgcagctccgccttgatcttatgtaaactcatctgatagccctcgtttctcttaagtgttcgcgtactgttctcatgttgcgtttggttgccttcgcaacctctcgcacggacatgccggaagcgaacagccgcaccatttcgcgcacttcctcatccgtcacgcgcggaacgggatcgggtagcagtccgcgcgtgcgcagacgcgccgcaacagtagctttgctgcgtcttgccatctcagcgatatctgcaacatttctgccggctttgtaccattcgcaccattggtctatgtccgcgtcgctgaccggaccctgcacgcctttctgcggcgtacacagtgccggcacaaaaatgcctgtcggcacctcgctgcacagcccgcgtgcatcgtcctcgggcgtaaatacgcattcgcgagtgtagtatgtgcaatgatcgaacagactgtaatgctcggtctcctgtatctcaaaccggccttgcgggtgtctccaaataacccgcgtcttttctttttctcgcatattgttcctcctgccgcgccttgaaaatggcgctttctatttctttcttcttttcccatacgtctggcagatcggcaaacggctggcagatcgggtaagccttgccctcatcgccgtaggttccgacaaggtgatactccacctcgccaaacagggtgcgctgtacctcaacgcgcaccctgtcgatccgcacccgcggcagctcggtcagctgagaatacggcttaatttccaatccgctaaatctctgcatggccgccctcctgttttttagcctcctgccgagcctgccaccgttcaagcagcagcgcctcgaactcggccgttccttgcgcaggctccggtcgcgctgcggcccttttttgctttctcagccttccgctttgctttttcgacagccttcacgtaccgcatacagcgttccacccggtcatgcggcatcagaaacttctgccggtttttcttccagtcggccatcagcggatctgcctcatcaggtcggcgcggtacgcaatgtgcgccgccttgtccatggagacgcgggccgccttgcgggccttgacttcctctgccgcccggcggcgttttgccgcacagagatccgcatagcagattgccatgcataccagcatcgccgttccaagcaccgccgcctgcatgcggctgcaggcacccgcgatctgcatgtacatcacgccgccaaacaccgccgccgacagactcatcataaacttacttgccttcatctttcttcctccgttcctgattcatcagtaattcccacgccgttttctgcaggcgctcaatgcgccgctgcatttcctccggcggaacgtcacggtagcagtcgtcgtctatgcgtaccgtaccgtttggataatgatattcagccacgattgccaccgtaaccacccctttctaaagcctatgcttaaaccggcttgtctgttgccgtccgcgccacttctgcctctaaattgaacttttgtgctttctcaagctcaatgcgggcagcgatccgcaggctctccggcgcttccgggtcagccatgatctgttctgccgtcatggcgaggtattcgttgaatggtttcatacaggtttcacctcgatcttttccgccttgccgagccactcctcgaccttctgcagcgcaacctctcggctgtcgccaaaatactgcgtccactggtacgcaatatgacctttttcggtcagaacccaaacttcgtacttcatggtgtgtccttcccttccgctgctcggctggctctgtgttcctaacaccagtgcgctaaacgaactcgcaaagtctatttcagacgcactcatcgcggcagcaaactaatttcccgcaacccccgtcagctgctgctggcgggggttgtcttatcctcacaaaagaaatcgaaaggcacgctcagtgcttcgcagattgcctcatagtcctccaccgatatacggtttctaccgtgtaataagttgtagagcttctgtttagtccagccgcacttgtcagcgataaaagtctgcttaatgccattctgtttaatgtagtcggaaatcttttcgtaaaaagccatctaacgtccctcaccccttcccgtccgcctgctcggcgttgttttcgttttccttatctgctatactgaaagcagaaaggaggtatttctcatgcctaaaatgttgcgtccgcaggatgcagccattatgcgggaagcgctggaatatcaagccgaaccgctcgatgcagaaacctttgcgctgatgctttcaaacaatatttcaaacccattgtctgaggagcaaaagcaagcggaagcgcttttgcaaaaagtctgtgcattccagtccgatcccgaaaccggtctgtttctgtctgacgaggataaagcgttcattgttgtttctctcaaacgccttatctcgttctatgacgaaatgctcaaaaccgaaaagcgctctaaattcatccgtgattacgagaaatcaattcgcgcatcacgcatttgtatctctcggcttgcataaccttgcgaacctgcttccggattcgttccggtgtacaccacccgccggaatacggcgccaaactgtaagaagtcccgtcccgcggggcttctttgtttttctcggtgtccatcctctcaccccttcccttccgcctgctcggcgtccagtgcgaaaagatattcaaaatcagcgtgaaacagacccataacctgttttgcttcgctcattttgaaatcttttctgcccttgagtttattccgcattgcgctttcgctgatgtcacagacgtccgcaagctgtttggtgttaatcttctgcttgaacatctcaagttccaagttcggatacattaacaacgctcctctcttttgctttattacgttctccgtagtataattgattacacttatgtacgacctcccagaaaggaggtctgtatgacgtttacaccgttaccgacgaatagacaactactgtccgacatgattaagcactcgcatatttcagatgagcagtacaaccatctgaaatttatagtcgaacagtctaacgtttctttgggcgaaaaaatgtctttaatgcagcaattaaacgaaaaattctctcgctaatttttccccttaaataatagattagggaggtcgtagcataagctacggtctttcaaccgctccgaaatacccttactcgtatttcttgaatatagaatataccctttctgataatctgtcaatagcattttatcagaaagggtatatttttattgtaaccgtttatattttgtggtatagtaaggcaaaggagatgaacgcatgaatatacttgacaagctcgacttgttaatgcacgaacgaggactgaataagcgaacgctttctcaagcctgcggcataccctatacaaccatcatcggactttacaaaaaagggtatgagggtgcgcgaatgagcaccgtccgaggacttgcacactttttcggtgtatcaacggactatctaattacagacgaaatcaccgacccgcattacggtctgtcgtcacctgctgcaccggtttccgacctcaccgctgatgaaacccagcttatcgacgactaccgcgaattcaacgccgagggcaaagaaaaggtccgcgactacgtcgcagaccttgcagataacccgaaatataaaaaatgtagtgaatctcgcttggagaaacaagcgtaaataaaaagttcccgcctcggtggtgacacaccgggacgggataaaatcattcgtcactatcttctttatgttttaagtacgttcgtatctttgcatcgttttcctgcatactttttaccattgcaatcatattagcatcctcatccgccggaaacagatgttccgctatgattttcggaatcacaataaacgccgagatcataccggtcagcgcactgacaacaacaccaacgtcaccgagggatatgttaccgcgtatcgttacgatccagatactcacgattgctgtcagtacgatgaaaccaaaagccgcaagcgacacaacgaaaaaccagaatttatagtttttcttggatttgctctttttcacataatcatcaatatatactttcagcagttcggtataggcctgatttctcgcgtcatactccggatcgttttcctggctgatagctgccgtgatcagctgctcatcagatgttctgaccggcgtttcattgtcactttcttcttgaaatgtttttagaatatcgtgaaaatcagtatatttattaaccatatattaaataatcttcaaatcctgcagccgcacgcgtgccgcttctttggaaaccttgaattcatttgcaatgtatctgattttttcatcaaatgccgcaaagaaatctctttcctctaattcttccagcgcatcccgaaccattcgttccggcataagaatgttggacgcgaaaatattggcttcacgttctattcctcgctgtggcgtgtcgattacatctctgtgcgcatacagcgtctcatcttttttcttgtgtagaacataatgtgccagttcatgcgcgatcgtaaaacggcgtctcaccgctctgtctgcaagattgactacaataaccttatccgtgtgataccgttctctcaagctatcgtctacgccgataaaaccggcaaccttggagggtaaatattgctcatataccgcaatacccattgcattgcaaatgtctacaatgtttaccggataatgggtaatattattttgttcgcaaatttcatttgctttctgagcaatttttgcttttgtcagcataacaatacctcccctctacaataagaatatacgttaaatttgcacctgtcaaccacctgtccaaataatttgtcaaaggaagtgatcccatgcccaccgactatgccctgtacctccgcaaatcccgtgccgacctcgaagcagaggcgcacggcgaaggcgataccctcgcccggcacgagcatatcctcatggagcttgccaagtcccgtgccctgcccatcggcgcgatataccgcgaaatcgtctcaggtgagcgtatcgcaaaccgtcccgtcatgcagcagctgctctccgaggtggaggatggccgctggaagggcgtactcgtcaccgaaacctcgcgtctcgcacgtggtgatacgatagatcagggtatcgtcgcccaagcgtttaagttttcgggcacactcatcgtaacacccgccaaaacctacgaccccacgcaggaggcggatgaggaatggatggagttcggcctgtttatgtcacgtcaagagtaccgcatgatccgccgccgtcagctggccggaacgagagcatccaagaaagaaggccactacgttcccggacgtccaccttacggctatgaacgctacaaactggacggccgcggctggtcccttagaccggttgagccgcaagccggtgtgatccgcaccatctacgatatgtatctttccggcaaaggcttttccgaaatcgcgaacgaactgaacgctatgaagatccgcacaccgctcgataaaaaatgggtgcccgcgactacccgtgccatcctgcagaacccgcactatgccggttttatccccagtgccatgaaggtcaacacaaaaatcgtgcaaaaaggcaaattgataaccaagcgaccggtcaataaaaactgtgagctgtacgaaggaatacacgaagcgatcatcccgcgggacgtctggtatagcgtccaacagcgcatgaaagacaccgttacgccgcgtgtaccgcgcaaataccagcagatgaatccgctggccggactggtctactgcgaccaatgcggtaaactgatgtctcgccatccataccgccgtgaagataaagtccggtttggctgtgaaaatccgtcctgctctaccgtctccagtctgtttgaagatgtggaaaaccttgtcctgcagtctctccgcgaatttcttcacgagatcgaactcagctctcctacccttctggacacgaaaagcgaagaaatcgcactgcagaatatcgagaagcagcttaccgatataaaccaccgtctgcagcgtacctatgaactgctcgaagatggtgtttacagtaaggaaaccttcctgcagcgtcaatccgcaatcagccaggatcagaccgcactgctaaacacaaagcacgagatcgagcgcaaactccataataaacagacagacattgaagcgcagaaggactccgcgccactcatccgtcatgtgctggacgtataccccacactggaagatccaaaagaacaaaatcttctcttaaagcaggtaatccgccgtatagactaccataaaaccgtccgtgtctacggcaaagccaaaagcgacctccatctgacaatccaccccaaaattgctatacctcaaacctctaacatttaagttattgctgctgcgcgctgcatgaagtaccccattcaatctgctcgtgcttcggcggtgacgatctcgtgctcagcaacgatggctatcagctgttcgtaaccctcggtcagttctcgatcatccgacttgagcgcgacattcagctgctcatgcccgcttacgacgtatgtctgccgcggcgcgactgctcgaacagcggtgtcggcggtgagcaggacccgtgcgagatcttctcgagcttcgacttccccatcgacgcctttttcccgccgcagagcgacaaggcaggctgtctgttcaccggcagtgccggcgtaaatgacaatcgcagcggctgcggctgcggcaataacaattcctgcagcggcaataattcctgcagataatctatctacccgtttacacgcagccggctgggagtattggctcccagccggctgtaaattcgccgttctgtatgacggcaagccgatggttttcgactgtccgttaaaaatgaagccgtcggcaaattcgatctatgacctgaaggatgccactgctgaaaaagtttctctattggcgcaaaaagtccctcatcgactgatgagggactttttgcttgtgcagttttttggttctgagacttcgcttagtacgcgatgccccagacaaccatcttgtttgcaggcttgccgcagaccggacaggtatctgcgatgtgctcctgctcgaacggcatgcagcggctcggcataccggtctcttccttgaccttctcctcgcaggcgaggtcgccgcaccacatggacttgataaagccggtgtgctcagcaaggatggacttcatctcgtcaagagactttgcagtataggtatgcgcctcgcggtttgcaagcgccttctcatacagcgacttctggatatcctccagcagtgccggaatggtcttttcgagatcctcgaacttaacaacggtcttttcgcgggtgtcgcggcgaaccagtacgcactgaccctcagcgatatcgcgcggaccaacctccagacgaagcggaatacccttcatctcgtactcggcaaacttccagcccggggtattgtcgctcaggtcgatcttggcacggatgcccgctgccttgacctgctcgtacagctcggttgccttctccttaacgccttccttgtgagccgcaaccggaataacaaccagctgggtcggagcgatacgcggcggcagaaccaggccctcgttatcaccgtgcgtcatgatgattgcgccgatgatacgggtggaaacgccccaggaggtctgatacatatactgcagggtgttgttcttatcggtgtactgcatgccgaatgcgcgtgcaaagccgtcaccgaagtagtgcgaggtaccggactgcagagccttgcagtcgtgcatcatggcctcgatggtgtaggtgttctctgcaccggcgaagcgctccttctcggtcttttcacccttaacgaccggaatggccagccattcctcgaagaacttcgcgtagatgttcagcatgcgcagagtctcttccatagcctcctcggcggtagcatgaacggtgtggccctcctgccaccagaactcacggctgcgcaggaacggacgggtggtcttttcccaacggacaaccgagcaccactggttgtacagcttcggcaggtcgcgccaggagcgaacgatctttgcgtaatgctcgcagaacagcgtctccgaagtcggacgaacgcacagacgctcctccagcttgtcgttgccgccgtgcgttacccatgcacactccggcgcgaagccctcaacgtggtcggcttccttctgcagcaggctttccggaatgaagatcggcattgctacattctcgtgaccggtctccttgaacatgccgtccagcgtgtgctggatgttctcccacagcgcctgtgcgtacgggcgcatgatgatacagccctttacggacgaataatcggccatttcagcctttttaacaatatctgtgtaccactgcgcgaagtccacgtccatagacgtgatctcgctgaccagctttttcttttctgccattattcttcacctttctggttcgcaataatcttatctattttttcctgttcgttttccagcgcatcgttgccccagatgtagaatacatcatcggttgcagaccggacggtaatccttccgtctttcaacaggcaggtatagtgtccgcttctatggccctctgtcggaatagcgattgcgaagcgaacagcaccgcttttgaccgtctttacctcgtcgatcagaatgtcctcgagtgttgtaagcgtggtctgcgttccgtccggcgcgatacgcacgagcatatcacccgccatgtatccgataccatccgaatagtattccgtccgctcagacttatcgcaggaaacagcatagtaggccccatccgcatcctgctttacgctgatgaccggagagtctgtcacctgcaccagacggccgttctcttcgcggtacagcccggctgtgccccagagcaacgcaccgtcgctgccaattatccgcggcgcacaatgcttgcgcacctcagcatcatccgactgatatgcattcgagatggtatagctgtctgtcttttgaccgtcccagttatacgccgtcagcacggtttcgtccgccgtacagttctgcgtaacagtcatgccgttatccgtcagccggcagatacccgctgccacgcctaacggctccacgcctgtttccgtgagcttataaccggtcgtctcgtccgtgcagataatgcagccgcgtgcgctctgataagcagtgcgtgctgcctgctgctgtgcttcggtcagggtcagttcggttttgaccgtatcgccgtgcactgagcacagcgaatacgtttccgtttttcggtcgtacaccagcagataatcggtttctccggcacggccgagatattccacagagctttcctgcggcagcgagagcacttgcgtcagtttcatcgtcttgctgtccatgcggtacagagtcaagtccgactgcctcatatcgctctgcgcataacggtctgtaccgctgacaggctgcactccgtcaatcggacactgcgccactgtcacatctgcaatctggcagacgaacggcgaagcaatcaggttccatttgccatcgtactggtaatcattgctgtaatcacgcggcagaacgtcccatgccgcatttttgaactgttccgccgtgaaaatgccgtcgtcgatcagcttttccgccacactgcggtcgctttcatcgccatttttcgcgtagttcgtactgagcagccgcgccgagagcgaaaccgcatctccgcggataaagccctcctcgtccgtctgccgtacctcatcgttatcgacaaaacccgtaccctgatagctgtccgcatctaaatgtgcccgggtcagaaaaatgcaatactggtcgcaggtgacattgcgctgcgagccgtacaatgtcgcggaaacgcccttggtcaaaccattctgatacagccagccgacatatttgtccgcccactgcggcacatcggtaaacggatgcttccagtttcctgccagcgcggtcttttctgcgccaagcagacgggtcagcatcaccgaggcctctgcgcgggtcatggatttctccagcgcaaagcccttgtcggtgcctttgaacagtccgagatcataaagcatctgcgcctgcgcttcggtatcgccgggatagttgttgtcgatcgtaccgacctgtgccgcaccggcggcacaagtcagcagacctgccatcagacacgcggaaacaaattttttcatgccgcaccctccctgcatacataacaaaactctatgaaccttttattctattgtgacggagaacggaatatcgcttccgctctccgttttgctgcttacttcagcttattctcaacctcatacgcgagcttctcgataaactcgccggtctccatagcggtggtctcgccggtcttgcgggtacgaaccgagataacacccttttcctcgtccttgtcgccaatgacgatcatatacggaaccttgtgaacctgtgcttcgcggattttatagccaatcttttcgttgcgctcgtccatggttacgcggaagcccttatcagtcagctgctgcatgacttccttggcgcacgggatgttgcggtcggtcatcggcatgatgcgaacctgctccggtgcgagccatgtcgggaatgcgcctgcaaaatgctcggtgataacgccgatgaagcgctcaatggagccaaggacaacgcggtggatcataaccggacggtgcttctcgccgtctgcgccggtgtactcaagctcgaaacgctccggcagctgcatatccagctggatggtgccgcactgccaggtacggccgatggagtctgccagatggaagtccagcttcggaccgtagaacgcgccgtcgccctcgttgacaacgtagtccttgccaatctcggtgatggcctctgcaagggtcttctccgcaaactgccagtccttcagttcgcccatgtgatcctccggcatggtagacagctcgatctgataggtcaggccgaaggtggagtaaacctcatcgaacagacgaacgacgttcttgatctcgtccttcatctgatcccaggtcatgaagatgtgggcatcatcctgcgtgaagcagcgcacgcggaacagaccgtgcagtgcgccggacagctcatgacggtgtaccagacccagctcgccgacacgcagcggcagctccttgtaggagtgcggctgagccttgtagaccagcataccgcccgggcagttcatcggcttgattgcgtaatcctcgtcatcgatgacggtggtgtacatgttctgcttgtagtgatcccagtgaccggagcgctcccacagcttacggttgaggatcatcggggtggagacctcaacgtagccgtagcgcttgtgtacctcgcgccagtagtcgatcagggtgttcttgagggtcatgccgttcggcaggaagaacgggaagcccgggccttcctcggtcagcatgaacaggccgagctccttgcccagcttgcggtgatcgcgcttcttcgcctcttccagcatgttgaggtactggtcgagttcgtccttcttcgggaatgcggtgccgtaaatacgctgcaacatcttcttggaggaatcgccgcgccagtaagcgccggtaacgttcatcagcttgatgccgttgccctttacgcggccggtggagtccagatgcggacctgcgcacaggtcagtgaactcgccctgcttgtagaaggaaatggtagcgtcttccggcagatcgttaatcagctctaccttgtacggctcctcgcgctcttccatgaacttgatggcctctgcgcgcggcagctcgaagcgctcgagcttctccttctccttgcagattttgcgcatctctgcctcgagagcatcgaggtgctcctgcgtgaaggagaacggcgcatcaaaatcgtagtagaagccgttgtcgatggacgggccgatggccagcttgacctccggatacaggcgttttactgcctgcgcgagaatgtgcgataccgtgtgacggtaggtgtcgcggtattccttgttctcaaacgtgtacttgttttcttcggacacttttattcagacctttcttgtaaaatcataacgagtggagtaattgataatggagaatggaaaatgaaggtatccgtccacgggacggaattttatgacgcgttttgcgcgtaaccacaattctcaactctccattttcaattttccattactgcagagtaacaaaaaacgctcacccctgtatctctcaggggtgagcgcttgcccacggttccaccctgcttgcagcccttgcaggactgccgctcggagttcttaacgcgaacgacacggcacagcatactgcggttttccgctgtgcggctcgggaatcggtactgttttctccgcattgcgtgtgcttgcagccgtggcgcacgctctctgccaaatgcttttcggaaaacaggatttccgtcattgcctataacttaataaatacagatttattataacgctcatatccgcgctttgtcaaccgatttcgcacgaaaaatgaagaattgaaaaatgcaggataccatcatcctctatttttcattcaccattactgtgcctttgccttggtaattttatctgcagcaagcaaaatgcccagcttgccggattcatatgtcaggccgccctgcatatagcagacatacggctcacgcatcggtgcatcggcggaaagctcaatggacgcgccctgcacgaacgcgcctgcagccatgataacctggtcgtcgtaacccggcattgcccacggctcgggcgtgacataggaatcgaccggcgcaccggcctgaatgccctcgcagaagcggcgcagcggatcaggcgcaccgaacgcgatggtctggatgatgtcgtaacgcggctcttcggccttcgggctgacctcgtagccgagcttttccatcaccttggcgcagaacatcgcggtcttgatggcctgcatggtgacatgcggcgccatgaacaggccctgatacagcaggcggttctgacccatcgtacagccgcattcgccgccgatgccgggtgcggtcagcttgtaggaggcgttctcgaccagatcggcacggcctgcaatatagccgccggtcggggccagaccgccgcccgggttcttgatgagcgagcctgcaatgatgtccgcaccgacctgcgtcggctcgatctcctcggtgaattcgccgtagcagttatcgaccatgatggccgcagtcgtattgacctcacgcacggccttgcagatttcgccgatttcctcgacggaaagcgtcttgcggacgccgtagccgcggctgcgctggatgaataccagcttgatattctcatctgccgccgctgccttgatggcgggcaggtcaggctcgccgttcttgaggtcaacctgcctgtagccgatgccgtagctcttcatgctgccgcagtaatcgccggtgatggtgttctgcagcgtgtcatacgccggtccggtaacggacagcacggtgtcgccggtcttgacggcggaaaacatcgcgcaggagagcgcgtgtgtgccgtttacaaagccgatacgcacgagtgcggcctcggtgccgaaaatatcggcgtagatcttgtcgagtgtgtcacggccgtagtcatcatagccgtagccggtcgtgcccgcgaacagattgtcggatactcggttcttcgcaaatgccgccagcaccttctcggtgttgcagtcacagatctcctcgagacgctcgaaatacggacggatctcgcgttcagcctcacggccgagcgcacgaatctccggtgaaatcttaatatattcagacatttatgtgtaatctccttctatcagagtgaagagtggagagttaagagtgaagataacgaaacggtttcgctgtctctccactctgcaatctccactctccactttttctatataacgctttcgccgtccggcagcgtaaacaattcactgtccggcgtttccgtgctgagctcgctgacggtgactttgcgcgtcagcgtatcgccgtcatagaacgacgcctgcgccagcagaccgctgaccgttgaaacggcatatacgcagcggtagccgtcctgctcaaacgtaacggcaatacacggttcaccgttaatatcctgccggccggcagcagtcagctgtacttcgtcagccagaacatcctcgtatgtcggcagcatagcaactgcgtcatcggtaaaatcgccggctttgccctgataagcagtgctgtcccctgcattccacgcatacaccttgctgtccggaacgcgaatcagcgtagactgcacctgattgtcactgccgagtgtatccgtgcgcatcacattatcccgcacatagcgatggcagtacagagccgccgagccgccatcatagtagatcgtgttctcgatcctgctgctgtatgccgccggacgtgcgagcgtcgcaataacggtcttggcgttattgacatcaatggtaatatcatccacgctctgcccggtgagcagcgcactgcctgtgccaaccgttggcgaatcgccctcactgccgggcaggataatgccggtgctgctgccgtgcatccagccggaggacagcacaaagctgagcaccaccaacagcacgagcacggtagcgcccgcagccgcaatcttcggcgtagtgtccggcagatagtgtttcggcgtatgcttctctttttttacgggtttcacgggttaaacggagccggaccgtcctcgcgcagaccaaaatactgctcgatcgcctgcacgatacgctgcgaggtttttccgtcgccgtacggattgacagcgtgcgccatttttgcgtaagcgtcctcatcgtcaaacagctcacgcgcgagcttaacgatattggcctgctccacgcctgccagcttgaccgtaccggcctcgattgcctccggacgttcggtctcgcggcgcagcaccagaaccggcttgccgaggctgggcgcctcctcctgcagtccgccggagtcggtcatgatgagatagcagcgtgccatcaggttgtgcatctcgtccacggccagcggatggatgaggtgaatgcggttattgccgccgaggaatttctccgcagtctcgcggacatacgggctgaggtgcaccggataaacgaagtgtacatccggatatgcttcgctcagctcggcaatggcgcggcagatgttctccatcggctcaccgtagttctcgcggcggtgcgcggtaacgaggacaacgcggttgttctcgaagtccagcgttttgagctgctcatcgcggaactcgaaatccggctttacggtcatgtggattgcgtcaacaaccgtgttgcccatgacaaacacgccgtctgtgataccttcctttgcaagattatcacggttgcgcggagtcggcgcaaagtgcagcgttgcaatctgaccggtcagtttgcggttcatttcctccgggaacgggctgtacttgtcgtaggtacgcagaccggcctctacatggccgaccggtaccttgtgatagaacgccgcaagcgcaccggcaaaggtggtcgaggtatcaccgtggacgagcacgatgtccggctgtgccttttcgagcacctcatccagaccgtgcaggctcttctcggtgatggtcgccagcgtctgacgcggctgcatgatgttcaggtcataatccggcttgatgtcgaaaatatcgagcacctgatcgagcatctcacggtgctgcgcggtaacacacacaatggattcggtgttttcattctgctcgagcgcatgcaccagcggcgccatcttaatggcctccggtcgggtgccgaaaaccgtcattaccttgatcttattcatcgtctttatcctccttattttcgggagcgtgtttgctccagtgttccgcaccgtaaatgatgcatgcacctaccagaatggccgccagaaccgccagcagcagcacgatcgccttaacctcgccggacgaggtgagcaccacggcagtcaggccgagcgttgcgctgatagcgtacaggatagcaaccgcctgcttctggttgaagcccatgtcgatcagcttgtgatgcacatggccgcggtccggactcatcggacttctgcctgccgccacacgacggatgatggcgttggctgtatcaaaaatcggcaggccgagaatcaggaacggcaccgcaaacgagatgactgcgtaaaatttgaacagacccatgatggacacggtcgccagcatgtagccgaggaaggtcgagccggtgtcgcccatgaagatcttagccggattgaggttgtacggcataaagccgatgcacgcgccggcgagcgccgccatcgtgatggcaatcggcatgttgccggtcagcagtgcaacggcaagcatggtaatcgccgcgatggacgaaacaccgactgcaagtccgtccagaccgtcaatcagatttaccgcattcgtgatgccgacaatccagataatcgtgaccggcactgccagaatgccgagatggacaaacggcgtatccgacagcggattcagattggtgaacagaccaatctgcagatcgccgatgcagaccggaatggctgccgccacaatctgcaccacgaatttgagcttggcgccgagcgccagcacatcatcgaaaatgccgagtgcgacaatgatggccgctccgagcaggacgcacagcatggtctcatcgagctgcccgaaaatcagaatcgaacacaggaagccgccgtaaatggccagaccgcccagccgcgggatcggctttttgtgcatgcggcgtgcatccttcggcacgtcgatcgcgccgaccttgtgtgcaaagttcttgaccggcggtgtgaaaaaatagctcagcacggcagctacggcaaacgctgcaatgatcgtgccgataacaatatattcagacatggtttactcccttttggctcagcgtgcgacaaagcctacctttcgataaaccttatccagcgttttacgcgccagataggaggccttctgtgcgccctccttgtagacctgctccagataatccttgttgttcagcagatcggtggtcttttcacgaatcggacgcagcagctcgacaacggcctcgccgactgcgggcttgaactcaccgtagcccttgccgtcaaactcggctgccgcctgttcgatggtcttgccggtcgccagagcgtaaatctgcagcaggttggaaacacccggcttgttctgcgggtcaaagatgatgcgggaatccgagtcggtaaccgcacgcttgaacttacgcataatatcctccggcttgtccatcagcagaatatagccgttcgggttcgggtcggacttgctcattttgctgttcgggtcaaccaggctggtaatcttggcaccctcgccaaccttcgggtagtagccctccggaatggtaaaggtgttcggatgcagattgttgaagcggtttgcaatgtcgcggcagatctcgatgtgctggctctgatccacgccaaccggaacgaggtcggtctggtacagcagaatgtcagccgccatcagaaccggataggtgaacagaccgacattgatgttgtccgcgtgcttggcggatttgtccttgaactgggtcatgcgggaagcctcgccgaacatggtgaagcagttgagcacccacgccagctccgcatgcgcgggcacatggctctggatgaacagaatgctcttttccgggtccagaccgcaggcaatgtactgcgcgatcagctcaagcgttgcacggcggagcgccgcaggctcctgccgaaccgtgatggcgtgctgatcgaccacgcagtaaatgcagttgtactgctcctgcaggatcgggaaattgcggatagcacccaaatagttacccagcgtcagcttaccggacggctgcacgccggagaaaatcgtttttttctggttatcgctcatgtatatacttcccttgcttagaatttttcggttcaattcaccccgaaaggtttccatacttaattgtaatgataccacactttaggaaaggttgcaaccgttcaaaaagttaggaggcaggagtgagaagataggagtggccaatgatgaacgtttttcgcaggggcgcacagtgtgcgcccgtcccagcggcctgcaacggataaagaaaaagggcgcacactgtgcgcccctgcgggagagctgaaggcaggaaaactcctgcctcctaactcctcactgtttgtttactctggccgttccttgaccttccgcaaaatggcccactcgctgaccttgaacgggaacgcaaagtgtacgcgcatctgcggcacgttgaacagctcgcgctcagtgccctcatcatcagtgacgttctccgcgcggaacacatacggcgcctgacccggctggatcagctccagctcttccccatcgaaaaagcggttcttgagtgcgaacacggctttgccgctgtcgtcacactcgaccggcatgccgacaacctcgtactcgcggatatactggctgtcgccgtaatgctgtccgttttcctgattgccgaagtagaagccggtgtaatactcgcggtggctaaccttattgacctcatcgcggcagaactgcggcaaaacgaagttttccgggtcctttttataggtgtcgatcgcggcacggtatgcaccggtgacacaggctgcatagtacgcagttttgttgcggccctcaatcttgaacgaggtaataccggcctcgatcagctccggaacgtgctcgatcatgcacatatccttggagttatacaggtaggtgccgcgtccgtcctcctcgaccgggaagaactgccccggacgcttctcctccatcagagaataattccagcggcacggctgtgcacatgcgccgtggttggcgtcgcggccggtcatgtactgcgagatcaggcagcggccggagtacgaaatgcacatggcaccatgaacgaaggcctcaatctcgagttccttcggagttttggcacggatttcagcgatctcctcaaaggaaagctcacgcgcgagcacaatacgctcggcgccttcatccgcccagtagtttgccgcctcgtggttaaggatgctggtctgagtcgagatgtgcaccggaaccttgggcgcgtatctgcgcgccatgcgcagcacgcctacatccgcgatgatgaatgcgtccgcgcctgcgtcctgcagcagctccagataggccggaagcgccggaaggtcgcggttggacggcataatattgactgtaatgtagcacttgatgccgtgcgcgtgcgcgtaggcaatgccctcgcgcagcgcgttatcgtcaaagttggttgcagcagcacgcatgccgaagcgcgttccggccatatagaccgcatccgcgccgtaggcaatgccaaaccgcattttgtccagatcgcctgcgggcgacagtaattcaggtgtgttattcaccggttgcctccgttgtcgtcgtgtctgccgaagcgcttgcagcctgcgcctgtgcctgattggaagcctcgatgttgcgctcgtgctcctcatagctgcttgcaaacaggtgcgagccgtccggcatagcaacgtaatagtagtaattgttgtcctccggatggcttgctgcgtacagcgaagcataacccgggttgcagatcggtccgggcggcagacccttgtggttgtaaaggttgtactcggaatccgatttgagatcctcgtcactcagcttgccgccggtgcgtcccagaccatacagaacggatgcatccacctgcagatacgggaactcggaggaattgttcagacggttgtagataacgcccgcaatgcgtgcgcgctcatcatcacgctgtgcctcacgctcaatgagagaggcgatcgtgacaatatcgtgcatcgagcggccgagattctccgcgccggacttgatgtccgcgtcatacttgttgccgaagttgttgagcatcttgttgatggtatcgacaaccgcagcgttgcccttgtatacctcataggtatccgggaacagatagccttccagccagccttccgcggccggtttttcatcctcaaggaaatcgtgcttgaaggaatagtcattcagcacctcatccagcgcatcctcggtgcagatatggttgtccagcagcacctgacgaatctgcgagatggaataaccctccgggatggtaatctgcacggtctccgtgcttgcggtattggccagcgcatctacgatctgaccgtagtccatcgacgggttcagctgataggcgcctgccagaaccgaggtatcggtctggtgcttgagcgtcagatacagcttgaacaccgaatgataattgataacgccctggtcgtccagctccttggcgagcgaggataccgaggtgttctccgaaaccgtgatctccttgaccgcatccgccttgacaaaggcaaaaatgtcgtttgccatgaacagcgctgcaatcgacagcaccagcgaaacgccgactactgcgatcatgtacaccatcgagcctgcacagcctgcgttcatctggcggcggctgcggcggcgtctgggctgtttctgcggctgctccggctcccgatcgtcatcgaaatgctccggcgtgaactgctcaggcaccggcgattccgaacccggcagcggtacgcgccgcgtttcatcgttgttaaaatgattatccataattcacctctctgcggatcagcctcagccgatccagtaattcagaatgattttaccggcaaatgccagcgcgaacacaataaatccgggctctttcaccagcagccacaggtcgtaccagccggcgctgacctcaaagtgcggaatggaaccgcgcgccagcatttttcccagtgtgtccagcgttaagaacgcgaacagcaggaaaaagagcacagtcagcggcagcaggatgttccaaatgccgaacggtgcataggtatctgctatccactgcatcaccacggtgacaaatgccgccgcagcatgggaaagtaccgccgcccatacggtatcaaacacataggtcagataggtaaacgccagtccggcgcagaagcctgccgccagatcaagcggactgccgtgcagcagtgcgaacacgatgccgccgaacagcaggcacgccgaggtaccgacttcttcaccgtacacgctgaacagtgcaccgcgtaaatagatctcctcaaccagagctgctatcacaacgccgatcagcagccgccatgcaaacgacataccgccgagcggcatcggcagggatgcaatcgtcagccggagaccggtatgcgccagcagacgatattccagcatgttcaggctgagggcggcaaatgcggtcgccgcgcccataaacaaaatgagcagccagccgcccttacgcggcattttgaatgcaagccgctgcttaaagcgcttccgatccataccgggcagcgccattgcaagcgccagaccgaagcacacgatctcaccgagcgccatcagcgacggcggcagattgaagtgcgtgatcagcttttccatgcctgtcagcaggcagaagcacacaaacaggctaagacccggcagcagtgtgcgtttatcttgattcatcggtgcgcagcacctctctttcggtgataatgtaatgacagcagcggtcgaacgcctcatgcggcagggctgcgctcatgcgctgcgatgcacacagcgccgcacagaccgcgtttgtccggctaaggaaccgatcatagtagccgccgccgtagccgagacggtacccttttctgtcgcacgagagcgcaggcgcaagaatcaggtcgatgttctccggtgcaatctcgggcgccgtgtcggacggctccaggataccgtagtgaccggtctgcagctcggagagcgcggtgattttccgcgcggtcatgctgccgcccttgccgcacagcggcacgcagaccgtcctgccggacgcaagcgcgttttcgagcaccgtacgggtatcaatctcctcagcagtcgaaacatagcagaaaatgcagtctgcctgctgatagaactcactttgcaggatgttctgtgcaataccgcgatcaatcgcctgcttttcctcagcggacagacttgcccgttccgcaagatagcgcccccgcagcgttttcttatccgtacacatgatgtacgaccgactctgcgatctcgtctgccttggccttgccgcacagcgcggtaatcagctcgcacgcgaaatccagtgcgccgcctacaccgcagccggtgatgatcttcccatcggtgacggcgttcgccttgaccggggtcgcgcccgtcatgccgtcctccatgcccggatagcaagtggctttcttgccctcgagcagacccatgccgcccagaatgatggacggagccgcgcagatggccgcaacgtacttgcctgcatctgccatcgtgcgaaccgcatcggtaacgcgcttgtccgcgtacagattggtcgtgcccggcatgccgcccggcagaatgagcatatcggcctttgcaaggtcaacctcgtccatggacaggtcggttacgacattgatgccgcgtgcaccgcacacggttgcaccggtcacaccgaccagtctggtctccacgcctgcgcggcgcagaagatcgaccggagtcaacgcctcgacttcctcgaagccctctgccagtaatacatataccatgtttgtcacacctttcagttgagcattaaattcatatatccagcggtttcatccgctttctcatgccatttgcatacaccgagtgctatttcgctgccggtttccgtcacggcgagcatatcgcgccgcagcacgtccagcaggccctgcatctgcgcgtcatctgcgccgagcagctcctgcgcattgtcctcccagcagaacgcatagccggtgagcgtttcgtcctcgaaccagccatacacgcccgcgccgagcgtgtcgaacagcgcaagctgcgcgttccagtacgctgtgtcccgctcgatgcggcatttcggcaccagcttgtcatacagcgccgccagtgcaggcacatccgccgaggtcagccgccgaggtgctttgcgctcccctgccgtgcaggtaatctcccggcgggaaatatggaagaacggctcgtagccgaacggtttgtaaaaatcaaacagccacttttctgccggaatgagcacggacgcaatgcgccccgtttccctgtccaactcgaacgagcgctcgagcagccgcgccatataccccttgcggcggtacgccgggtcggtacacgcgccgtagatatacgtcacctcgcgggatacgccgcctaccgtcatccggtacgggagcatctgcaccatcgccacgagcgtttcaccctcgagatacagcagcgtatatttctctttatagaagtgcgcgaagaagtagtcattgaagccgccctcatccggaaaacaggtttcccagagggcgcgaacggcaggaaaatctcctttttcggcaaatcgcatcatttcaatcaacctttcggtgttgccacatatttcacgccgcgcatggccggataataggacttcttcgccttgcgcagaccctcgagtcccagatcctcctcgcggttgacgtattccacatcattgcagttgcgctgtacgaactgctggttgatcatctggtacgcgccctgaatcgtgtggtcggccttttcaatctgtaccacgaacatatccggcgtagccttgcagccgaacgtgaacgcgataacctcgccgtccaagcgaagcagtccgccgcgcagattcaagtagtcgaagttgtggagcgcctgcacgatcgcgcaggtctcgccctcaaaatcgcgctcgcgtgcacagccgttcaggttgcaccagtggatgtggaacgcgaatgcgtccttgatgttttccctggtcatatcctcgtagctccagcggccctcgtaggcagccttgaagcggttgacgaggttgcgcttgctctgcaatttcttaccggagagcgtgcgcagcttttctgcgaggtagatataatcgtcaccgtcctcgctgtcatgcgagaacgtgaacttgcccggacgaacggcttcgatacgctcgatcatcggctcagcgaccgagacgatgacgaacggaagaccgcgttcagcggcatcctgctcgagcgcatccagcacagcgccgaggtcgccctgaccgacaggcgcaagatagcagtcgtgtccgccgtccagcggagacattttcaccagcataaagccgtctttgaagcagatctgcgtattgtagtggctgcgccacatgaaaagatcgacaaagcagcgctcacacagatgatagttgtaatgcgagccgcagtgctcgaccatcggtttatcttctaaggtaatttctctaaacggtaacatataattcctttcgcaagattgattgagggttacttgccctcgcgcagcgtctgatagtgcgcgcgcacctctgcagccttgccgcaggacattttgccctctgtgcagacaccgtccacgcaggccggtccgcagtgaccaaacagcgtcggcgcaacagcgtatacctgcttgtacatctcctcggcaagcgcacggatttcccactgagcgcgattgcagcagcgcaggcggaaaaagttcttcaggctgcgggcgttcgccgtcatgacgatgcgggtcgcgcaggcgttcggcagaacgtagcgtgcgtcctcaatggcgtgcttttcagccttgctgcgggcggtcttctccggaacgccctgctcgagcagctccttgaggtagccttccatcagcacggccgtcagttcctcgtaggtgcgctgatcgtcctccatcgcctgaataaattttgcccgggcagccggaattttatcaatctctggcggaacaacatactcaaagcccttctcacgcacatagcgctggctctgtaccgagaacgatgcaatgcggtggcgcgtgatctgcgccagcagagaacgcgatacaccctcgattgcaaaggtgaacgacacatgctcgatcgggctttcgtggccgatctcggaaagcatgttgacaaagctctcggtcttttcctcggtcagaccatccagcacgctgtccacgtccgtggaggaatagcagttctttgctgcagccgcgaccagcttttccgggtccggcgtgtaagcaagcagttttactttcattcttatcactttcccttcctgccgaaaagccgctccttgataacgatgagcagaaatttcggcagcttcatcatacggccgatacggctgggctgcttgagcagacgataaaaccactccagacccagcttgatgaagatatccggcgcacgcttggcaacgcctgcaaacacatccagcgagccgccgagaccgcagaacagtgtgctgtggatatcgtccatgttgtccgcaatgaatttctcctgcttgggcgcacccagacaaacgaacacaacatccgcaccgcctgcggcgttgatgctgtcaacaacctcctgcgggtcggagaaatagccgtcatgcgtgccggcgagcaccagtcccggatacttcgcacacaggtttgcacctgccttttcggcaacaccgggcttcgcacccagcagatacaggcgcatgttctccttggccatcgcggcaacaaggctctcggcaaattcaatgccggctaccttgccgtgcagcttttcaccgaggatcttcgcagcatagatgatgccgatgccgtccggcaggacaagcgtcgcatggttgacaacgcccatgaatttttcatcatggcggcagagatcgacgatctccggattcggggtaacaacgtagcccttctgccgggaacggatcttgctcattgcaagctcaacagcctgctgcttggtaacggcgtgaaattgcacgcccagaatagaagcagtattcatcttcgtatctcccatattttccagccttttatttggcggtaaacattcctaatctattgtattatacagcagcaaactaaaatctgcaagtccagcttgcagagagtgcggagtagatagcgataaacgtatcatgcagggtgggctgaccccggcccgccgcctgtaagtatgtgcagatcgttgcgaacggcggcatgaggtcatgccgccctgcgatatgccttggcaaacatcgttctctttccgcataggctgttaaggggaggtgaacccatggaagaactgacgcagtatatcaaggcggatttcgcggttctggtggcggttttatactgcatcggacgcggactcaaggcaatacagcgttttcccaatcaatttatccctctggcactcacgttctgcgggattggactggcctgtctgtcggtcgtatcgcgctatgccagctacggcaactgggcagccgcgctgtttgaaggtgtggtgcagggtgtcctgtgtgcgggcatgtcggtctatctgaacgaagtcatagcgcactgcagttcaaataaaggaaacgacccgccgaaataacacgcgcaaacaaaagaggaacgaagtgttccaacaatctcaacggcttcggatttccgaagccgttttcatttatccttacttgcagcggcaggcaatttgcggtacaatacccatataaactctgtcccctactttgggacaccaaggagagagacacgccttgtacgatttacaaactctgattttttacgccaaggagaaaaacacctccgatgtgcatttaaccgttggtctcccgccgatgctgcgtatcgacggtgagctgcatacccacggtgatgtacctctgaccgagcaggatgtgcaggatgcggcgcagcagcttgcggatgagcatcagctgcacgagctgaaaaccatcggcgagtccgactttgcagtgacgtttgccgattctgtgcgcatgcgctgcaatctgtttcgccagcaacaccacacggcgctggcgctgcgtctgctgccgatggaaatcccaactgcggagcagcttcgcctgccggatatcattatacagcaggccgaaaagccgcgcggactggttatcgtgaccggtcccaccggctccggcaaaagttccacactggcggcactgatcgaccacgtcaaccgcaccgcggcacgccatatcatcacgctcgaaaacccgatcgagtatgtacacccgcgcattcgctcaatgatcaaccagcgcgaaatcggcgcggacacggacagcttcgcaagcggtctgcgggcggctctgcggcaggacccggacgttattctcgtcggtgagatgcgcgatctggagaccatttcgaccgctatcacggctgccgagactggtcaccttgtattcggcacactgcacaccaagggtgctgccggtacgatcgaccgtatcgtagacgtattcccgccggagcagcaggagcagattcgcattcagcttgccgaggtgctcgagtgcattgtctgtcagacgctcgtaccgcgcaccatgggcggccgcatagccgcatttgaaattctgaccggcacttctgccgtgcgcaacctgatccgtcagaacaagtcgtatcagctgatcagcaccatgcagaccagccgcaatcagggcatgatgctgatggacgattcgctcggtgaactcgtccgcagcggcgaagtccgcctcgacgatgccgccgcaaaggcagccgacccggaagcgtttccgcagtctgtcttccgataagacagcaaatcccgcgttgaatttcacgcgggatttttatggcaatgccgcataaaagaaccgcggctttaaggcaataccgcataattgaacaagagtgatttgcgagtaaattttgcgtactgacgaggcacagttttgcggtaatacttgatgtattaccgtgaaacctcggcagcgcggacggaactcgcgcaaggaaccgaagccaaagtcaggacacaaaatttccgcaaagcaccgcggcagtgcgaccggagcctgcacaaggagccgccgctttaattgtgcggtgttgccttaattatgcggtgtcgctttatgcttgcaatgcgcctgcttttagcgcaggctaccgcaggttcgctcttacattaattctccattctcaattttccgcaactctacggagcgttcattgtattctcctctgttttccgtataatagaacgcaagggaggtgatccgaatggatcaggtaaaaaccggcagactaatccgtacaatgcggacaaaactgggactgacacagcttgcgctggctgaacagcttggcgtcagcgacaaggcggtatccaaatgggagcgcggcggcggtgctcccgatatctcgctcctcccattgttatcacaggccctcggcgtggacaccgaagccctgctgagaggcgatctggaggaaaacgatatgactaacggcaatatgaagaaaatgcggttttaccgctgtccggcctgcggcaacctgctgttctcgaccgatgacgcagatgtgacctgctgcggtgcaaaattgaccaacctcgttatgcacaaaccggacgaggaaaatgcactgcaaattgagcacagcgacggcgaatggtatatcaccgcaccgcatgaaatgcaccgcgagcactatatctcgttcgttgcatttctcaccggagacatgatgatcgtcaaaaagcagtacccggaatggggattagacgtgcgtctgccctatattcggcacggcatgctgctgtggtactgcacgagggacggactgttctatcagaacatctgagcaaaggcagggcagcctgcctttttattttttgcaggaggctttttacaatccttcatttttggttatatttttcgtaaaatcgacttgcttttttaggagggcaatggtatagtcaaagagaactttatactactaaagcttggaggtagttcaaatgtacaaagaaatgatggattccatcggtatgatccagtcgatcgaccccgagctgggcagtgcgatgaatgaggagctgcaccgtcagcgccagaatatcgagctgatcgccagcgaaaatatcgtttctcccggcgttatggctgctatgggcagcgtgctgaccaataagtacgctgagggtcttcccggcaagcgctactacggcggctgtgaatttgttgacaaggtagagcgcatcgcaatcaagcgcgcatgtgagctgttcggtgcaaagtatgcgaatgttcagccgcactccggtgcacaggccaaccttgcggtttacttcgctctgctcgatctgggtgataccgttatgggtatggatctgtctcagggcggtcacctgagccacggctctccggtcaaccagtccggcaagaactaccactttgtttcctacggcgtaaacgaggatggcttcatcgactacgctgagcttgagaaggctgtcaagaagcatcgaccgaagctgatcgttgcaggtgcatccgcgtatccgcgtgccatcgacttcgagaaaatggccgagatcgcacatggctacggcgcttacctgatggtcgatatggcgcacattgccggtctggttgccggcggtcagcaccagaacccgatgccgtatgctgacgttgttaccaccaccacccacaagacgcttcgcggtccgcgcggcggcctgatcctgaccaacaacgctgttctggcaaagcgcattaactccgctgtatttccgggcacccagggcggcccgctcgagcatgttatcgcgtccaaggcggtttgcttcggcgaggcactgcagccggagttcaaggagtacgcacgcaagatcgtcgagaatgccaaggctatggctgcgcagctgcaggcacgcggtgtcaagctggtttccggcggcaccgacaatcacctgctgctcgttgatctgaccgacgaggcgtgcaccggcaaggatctggaggcgcgtctggattcggttcacatcaccgccaacaagaataccgttccgggtgagaagcgcagcccgttcatcacctccggcgttcgtctgggcaccccggccgctacgacccgcggcatgggcgtggaagagatgaaggtcatcgcggactgcatcgcagactgcatctatcactacgatgagaagaaggacgagatttccgcacgcgttctggcactcaccgagaagttcccgctgtacgaataatctccggctgccgcggaactgcttcatccggatttcggagcaatacagcatgaagctcgcaaatccgatgatactcatacaaaaacagagcgtttcacagcagtgaagcgctctgttttcatttccgggtaagtctcaagcctcttgaagaatccattaagcacatttgcatctgtaatttttcgacaacagaaaaaggccgacgcctgcaaaatgcaggcgtcggcctcatacatatctgatgtttttccactaacgattgtcgtgggtttatggtaagtttgccgtttaacccttgaaatccccagtgttttcagcgtttttcggcacttcttagtacataccgcccatatccggtgcagccggagccggagcaaccggctccttcttatcagcaaccaggctctcggtggtcagaaccatcgaagcaacagatgctgcattctgcagtgcggaacggtttaccttggtcgggtcaacgatgccgtttgcaatcatgtcgccgtaggtctcggttgcagcgtcaaagccgtagccaaccttgtcagcgtgctttaccttatcaacaacgattgcgccctcgatgcctgcgttggcagcgatctgcttcatcggtgcttccagaccgcgtgcaacgatctgcataccggtcttctcatcgccggttgcctctgctgccaaagcctcaaccgctgcgatagcgtttacataagctacaccgccgcctgctacgatgccttcctcaacagctgcgcgggttgcgttcagtgcatcctcgatgcggagcttctgctccttcatctcggtctcggttgcagcgccaaccttgataactgctacgccgccggccagcttagccagacgctcctgcagcttctcacggtcgaagtcagaggtggtgcgctcgattgcgccgcggatctcagcaacgcggtttgcgatagcctgcttgtcgcctgcgccgtcaacgatggtggtgttctccttggttaccttgatctgacgggcagaacccagcatatccatggtagcgtccttcagctcgataccaacctcctcagagattacggtaccgccggtcaggattgcgatgtcgcggagcatatccttacggcgatcgccaaagcccggagccttaacagctacgcaggtgaaggtgccgcgcagacggtttacgatcagggtggacagagcctcgccctcaacgtcctcagcgatgagcagcagcttcttgccggccttaacaacctgctcgaggatcggcagcagctcctgaatgttggacagcttcttatcggtgatcagaaccagagcgtcatccagatttgcttccatcttctcggtgtcggtgcacatatacggggtgatataaccgcggtcgaactgcatgccctcaacaacctcagagtaggtctcagcggtcttggactcctcaacggtgataacaccgtcggtggaaaccttctccatagcctctgcgatcagggtgccgatctcgtcggagccggaggagatagcgcctacacgggcgatgtcgttcgtgccgtcaaccttcttggagttctcagcaatcgctgcaacagcagccttgactgccttggagataccgcggcgcattaccatcgggtttgcacctgctgctacgttcttcagaccctcacgaacgaaagcctgcgccagaacggtagcggtggtggtgccgtcgcctgcgatgtcgttggtcttggtggcaacttccttaacaagctgtgcgcccatgttctcgaaagcgtcgtccagctcgatctccttagcgatggtaacaccgtcgttggtgatcagcggaccgccgtacttcttatccagtacaacattgcggcccttcggaccgatggttaccttaacggtatcagcgagctgatcaataccgcgctgcagagccttgcgcgcgtcctcgccgtaaataagctgcttagccatgatgaattacctcctgaaaattactctacgattgccagaatgtcgctctgacgaacgatgatatacttctcgccgtccagcttaacctcggtgccggtgtacttgccggtgatgaccttctggcccttctgaacttccatcttgatttccttgccgtcaacaacgccgcccgggcctacttcgatgatttcagcaacctggggcttctcctgtgcggatgcggtaagaataatgccgcttgcggtggtctcctccgcctcgaccatcttgataactacacggtcgcaaaggggcttgagcttcataatggattcctcctatgaaaaataagattttacaatgttgggggttagcactcaaattacccgagtgctaacttcgagtattatcttacaccaaggagccgcaatatgcaagggggtaatccggaattttcacaaaaattttctgaacaaattatgaacagtgccctatagcgctcagcgttttgccggccgtttagcagacggtcggtcggagtgcttattctctcccctattcgatgcagacgggtctttaaaatacatatgcagctcgcacttgatcatgccgttgtacagcttgcggcgcttatccgccttgcggccgtagcagcgctcgaacagcggatccgagctgagcagatactgcttcatcgggctgtttttcgtcgctctgccgaggtcggcgtacagcttttccgccttctgcaagtccagcagacgctcaccgtacggcggattggcaaacagtacgcccgcattgctgtaatcgcgcttggtcgcgtccgcgcgctcgaaaaacaccgtgttggctacaccagccttgcgcgcgttctcgatggacagctgcacacagtccgggtcgatgtcgctgccgacaacatcgaattttgcgtccggctgggcaaggtcgagcgcactctcgcgcgcctgctgccagaccgacttgtcaaagcagctccacttctccgcatcaaagcggcgcagcagaccgggcgcacggcgctgcgcgatcatggccgcctcaatcgcaatcgtgcccgagccgcagaacgggtcgaggaacgggtcgcgtccgcgccagcgcgccagcttgaccatagccgccgccagcgtctcacggagcggcgccgcgttgctgttggcgcggtagccgcgcttatgcagaccggcgcccgaggtatcgaggtacagctcggctacgtcgtgcatgatggcgaactgaatctgatacttttcgccgatctcgtcaaaccaggtttgaccgtactttgcgcccaggcgcgatacaactgcctttttgatgatcttctggcagtccggaatcgagtgcagagctgagtccagactgtgacccttgaccggaaatgcgccgtccgccggaatgaactgctcccacgggagcgccttgacgccctcgaacagctggtcgaaggtctttgccttgaatgtgccgatgcggatgagcacgcgctcggcgcaccgcaggttcaggttcgcccatgcgagcgtgttctcgtcaccggtgaacagcacgcggccgttttccgcgtgcacgtcggtcagcctgccgccgaagcgcagctcgtccgcgacgatgccctccagcccgaacagggtcgggcagcataatgtgagttgcatatggttttcctccaaaaaggctcccgccgtcagagcaggagccgaaattcctttttaacctttatattgtatcgttttttgcgaattttgtcaagatttgcgacgagatgggctattttaaatttggtgtggatagagggtaaaacgcatatcccatgtcttctttgcagcttgtcaggcggatctcatttattgcggtcaacaatgcggaacaccttctgcgaattactcgcaacaaactcatccagcgagtcatagttcgtgaacacattgtcatccggcggttccggccaactccactgcttgatcggctcattggtattcacatcaaagaactttgtttccggttcgccgccctcgtatttcgtttcaaagagacagtccggcatgaactctgttccacaccagcctttaccttctccagtttcggcattatactgcgtaaagtaccagccgataccctccgcttctccttcttcctgctcaaaacgaacatatgggagatagaccatttttctcatttttcacacctcttttccctttcttatttgaggactatttttgctccggacaaataaaaaagtgccggtaatgaggatttcattaccgacacttttttatcgtgtcatttgatgactttttagcgttacaatatcactgcttgtatttgtcaccctaaaaaaccatcaaacatcaccctaaaaagagtccaaaccctgcattataccataccaatgtcaaccctgctaagtgcaaaatggaataggctacagcgacgtgtagacggcgtatgaggcacgatacaggcaagagtaaggggttctttccgaactgcttgccccctgctgtaccagcgattttgacgcaaacccgtagcatatcacaactcacttccctttcgctaatgcaagaactgcataagtccgggcggcgaaaatcgaacaattgttcgctttttcactggaatatggtataataattacaaagcaaatgttgcgtttaaagaaagaagggttattataaaattagaacatgtaaccattgacgatatgcttcgttcatatctaaagtctaatttcgctaactgcaacacactggtcatttggcctttaagcatgtgtgattccgaagctgaagttgagactattaaacaagatctcttcgaattcggttatcttccgccgaagagctattgccacaatggattctggattatagagatgcccacgcatacggcatttgaaatcatcaaccgtcatagtaaaggtacacttgcgatgcgttgttattgtggcgatgaatgtctccatgaaaatatgtgagcggagtaaaacaaaatacccgccaaagataccacctctataagggaaaaccgttaggggtgaaggttcatcaaaaatagcttgtcgcttgtttgagccctatgtagaatcaaaacctctaactcccttgaaacctgccgactgtgttacccacagtttgaggcctgtgtaaaactacctacctccaaccaaaagctgacgggcttacagacctctgctgagtttgagacctatgtaaatacgatacctccaaacctcgcccactatcaatccaaagatcccggtttgagacctatgtgaaaccatatacctccaaaccctgatcggtaatgtagctgccgttcttgcggtttgaggcctaattacatgcattttagcagcgtggtttgagacctatgtaaaatcaaacacttttaagacaagactcctaacgacggtaataggcgcatcttttgagacctatgcaaaattatctatctccaaaactcgtaaacgcccgtttcaatgcatcgacacgtttgagacctatgtaaaactatctatctctcaattccatcacaaggagtgattccgacgaagaagacctaccaatttaacgccgaataccaaacagatgacttagactttgctgttggcgtttcccttttcgatcagaacgacaatatggtgttttcggcatggaatctaaatgaatgccctgaggatgctgtaattggtcgagacctgttcgacgaaaaggacttcattaaggctgttaagctgggaatggagttagcaaagcagggatatgacgatgttaagtacgttgatcctacggggttgtatgggcctaaaatttaagcatttgaggccgcttgcgattgttttagagctatgtaaataagatacctctgcccccggaagttcgcgcagcttgccttcctcgtgtttgagacctatgttgagacctatgtaaaatcacttacctccaaaaccgtcggcattccaacataggttcgcgcttaatttgagacctatgtaaaatcaaataaaacaggtggaacaaacgattgcaggggatcgatgtttgatacctatataaaacaactcacctccaaacctttagcgtcgtctagaaaagttacgcgaaagtttgagacctatgtaaaattatccacctccaaccggatatgaaatatccgttccatcagggtttgagccctatgtcgaacctctttcagcggctatcccgtaccgctacgcgcgtttgagttacttaaccttgtaaattcacaaccattttcgcttatatataggaggcgatttctttgtttatcgtcggcattattgctggcctgtgtcttttcgcaacggttgtttgcgggaccgctgttattgcggccggacaggctgattacaacaaagctactcagagagattaagacctttctcttcttacacggttcctttttgagcgcctatttacctctattatcaccgttcagaccggtcgtttgagcccattaaatcctatacctctatttttagtatgccaaatacaagcgtttgcgcctatgtaaaactactcaccttcaaagcaccttcagtcccatagtcatgttccacctggtttgagtcctatgtaaaaatcagatatctttaactctctcaaaaatccacattataactttttaaatcttattccatcggaacatcgtcctcatccagtttgagttttgtaaaacctcttccttctgttatcaccgttcagaccggtcgtttgagtcccgatttgcctcgttttttgtcgaatttggtttaagctgttttgagattggattaagctaccctacggctttatggagtcgatcagtttatttgagcctacacgaaactgtctacctctaaaattaactgttcgttcagatgatattctcgctaatttgagagctatgtaaaattgtacctttgcagtgcgtcaaactttatgatttgagacctatttgaaaactgtacaaatcagacacttctaaaccagcagctcctcaatctgcctgttttagatctatgataaattagataccccccaaaaaagacactcttcattcatctttgagtctatgtaaaacggcccacctctaaaaccggctttagcaacagattctggaactgccagtttgaaacctatgtaaaacgagatacctctattttctacttattgcattgctacgttatttgcgtcaccgaacttacctcttttctagcggaacagtcgtcatcgtctaattgagtcttttgtgaaaattcccctttattttccctacagggtaccctgtttgagtcctattacctcggttcggaatcttgccgccccacttggtttgagcttaaaacctatgtaaaatcctctaccttcaattctcatatgcaaggagtgtcacaaatgataatcatcaatcctgccgttatcactaatactgctgtcattaacttatacaccggtgtattttctctttgtctttgacttgtcatcctgctcgctacacactttatcgaaaaccaccggattgcaggtccgttcactaatctgttccctaaaaggagctgttccttatgttatatccctacgccataagccgtgagagcgtcaatgggcatcgtgtctggatcgccaagagcctgcatttgaaaggctgcgtcgcccaaggagatactcgccttgaggccatcaaagagctggaatccaatgaaatagcatggcttaagaccgccagaatgctgcatatccctcaatcaaattaacacccacacaatcaaaaatccttactccatctgtacccttgcggttagatggagtttttttataaaatttgttttttgcgctacaaaaatcatttctttggtatttatatagacatatacggaataacgacaattctttagagcggctttagaaacatcgtgagcttgcaaaccaacttcttgcctttggtgatgagcattacatagaggagatgcgtttccgtgctctcgctaaaaaggcgatggaagctaagaacaataaaataatgtgaacataatattctattgttctgtgaggaggtgaggttatgggaaaatataacgttttgaaagttgatagtttgcaagattgttttttggtgattgctaacacatgtgaaaaccccataaacgatttgctatgcgatggagatgtttcgtttattgaaaatgggaatgttatatttgaccttgctgtaattaatggaataaacttcaatagatttattcaagtaacagtagagagtcaccgattgcaagcaaaaactattaagattatatctgacgttcctacaagtatacttgagataagcgaaaaatattttaagacgcataaagaagttattcaacaaagctcattgccatcagcaaccaagtatttactcacaaatgcataaataatggtaaaacttttgattcttactcttgacaaaacttactccatctataccccttgcggttaggtggagttttttatgaaaattagttttttttgcgctacaaaaatcatttctttggtatttataaatgtagatggcgaatgcggacaactgtatatttgaggattatgcaatgcttttcggatatctttaagtcttttccccacacacgtgggggtgatccctgggactttcaatatttttcgacatttccccacatacgtgggggtgctcccaaattccagaaaggaagtgacccaatgcagttaatacatgaactttcatggttatggaaaggaataggcattatcgctcttgtaagtgccatagtccttattgcagcattcaaactgcacaaagaagaatacaaaattgagattgcatgcattattcttatagtgactatactgatttgtattattgctatgattctatgcgctcgggttccgatgcccatataagcagtcaatgacccatgactgaagtcacgggcttgtgcaaacgagctcagattttaggcatgctcgcaagagtgcattgactaccctatgcaccgtaagaggtgccccgttgctcgcgaatagatagttaccgcatggcgttaatcctaactgtgcgctctaagacaacacatcacgtaaagctaaggtaaggccgacaggtgtggctgaataaaccgcttgcaaccttgggtaaggatttcgactcctcttttgaggagagcggcttcttcttagctgctagtttttagggcgagcccttgatgccatgctcatcacgcaaggctcgtacattgttgaacaataagaaagcgtgcgtagcaaagcgcacaccgtttaccattaagctcctgcacggtagtgcaggatacaaacagccgattacccttggcgttgacgcaggaagtaggtatgttggtctttggtgattagttttttcatacgtcctgctactcgccctcttatcacatctgagggcgagtaacagcatttcatcttcatttctttatcgaagccaatgcaagtcattggcggaaagcagcttctacttggaactacttgtaagttacttgaaagtttgctttcaagtgtttgcaactttttgcggttgctaatttctcatcagcaacgttgcgccaaattgccatattttcctcttaaaatgctataattacaaaaagctactacattgtgagataataatcaggaggtatcaaatatggttttagtcagcgtacaacccgaagataacggcttaacatcatttaaacaatagaattatggaatctgattaccagaaattcaacatgctgttaggcccttatatggatcgcatagagtccgcaatgcattaaacctttcctattcctctgctcaatttgagcagaggttttctttttgagccgatcactcaggctgattatcgcctgcacgacactgcagatgaacctcgctcagtttccggtattccacctgcgcagtatcaagcatccgcaacccaataaggacatcatcatccggcagcgttacaacagaagacatcttacagcgtcttgcatcaaagctgtcttccgggacatcgccgcagaactccggctttacaagtacacggaacatcttgtctttgttcttctctgcaaatctactgaacgaaccatacgtattccatgtataattgactatccgctcagcagcttcatcggtacaatgtcgtgccatgtcttctttgcagcttgtcaggcggatctcattgagtttgtagtattccagcgtatccgtatcatacagctttccatcatcgctctcctgcagcacctgaatgcccagcagagcgcctttatccgccagctctatcatcgtactcaggcgaccatagatcatgcagggacagtcctgtgcttctttattgcagtcaacaacacggaacaccttctgcgaattattcgctacaaactcatccagcgagccatagctcgtgaacgcattgtcatccggcggttcctgccaactccactgattgatcggttcattggtattcacatcaaagaactttgtttccggttcgccgccctcgcatttcgtttcaaagagacagtccggcataaactctgttccatgccagcctttaccttctccagtttcggcattatactgcgtaaagtaccagccgataccctccgcttctccttcttcctgctcaaaacgaacatatgggagatagaccatttttctcattttcacacctcttttccctttcttatttgaggactatttttgctccggacaaataaaaaagtgccggtaatgaggatttcattaccgacactttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctccggacaaataaaaaagtgccggtaatgaggatttcattaccgacactttttatcgtgtcatttgatgactttttagcgttacaatatcactgctcacgcatctttgcgaagcactcgctgcaatataccgggcggtcagatttcggctcgaacggaacgcgagcctcgccgccgcaagcagcacaggtagcggtgaagaactcacgcggaccgcgtgcagcattcttgcgcgcatcgcggcaggacttgcagcgctgcggctcgttctggaaaccgcgctctgcgtaaaactcctgctcgccagcggtgaacacgaactccttaccgcattccttgcatactaaagtcttgtcttcgtacatggtttttacctctctttgatactgttccctcgggaaacttgaaatatatgcgtacagacactgcgcctgctatcgcctaaataggtttaatggctgccgattttcgcttgatgcgctggacggcattatccacagatttgatcggtttgtgcagcgcttcggacatctcttcatacgataagccgtccaaaaacaacgtcaaaacctgtgcctcaaattcagacaaaagcgagtagagcttctttttccgctcttccctctcctcattgccgataacaagcgattcaggatcaccattcggtgcagttacccgggtacgcgattccgcaaggtcttcaaacagaggtcgatcgattgacatggactgattgagcgggtcgtgcttgagcgacgctgccgccttcactgcggaataaatcttccgcgtgatgcacaaccgtgcaaacgctccaaagggtgcgcccttgctctcatcgtactcccggacggcattcagcagcccgagcataccctcctgcatcaaatcctctgcatcggcgcctgccagaaagtagggccgcgcacaggtcttgaccagacgggtataacgacggatcagattctccatcgcgggtccgtctccctgccgtgccagacggcacagcttttcatcggaaatcccgttcgatggctgtatttgataatcatttctcatgtcaatagctattatacgcggtagaattggaaatgtcaagaaacgattgtcatctttaccgatatcacacaaaaacacgcttctgtttttatgcaattatgacaatattattaacgttttactctacagttaccgactttgccaggttgcgcggcttatcaacatcacagttgcgctccactgcgatatagtatgccaaaagctgcatcggaataatcgaaagcgaagcagaaaattcatacaggcacttcggcaggcgcacgatgtgctggcagaccgactcgtcgccggtgaaatcgtccgtggtgacgagcacgacgcttgcgccgcgcgctacaacctcacggatattggagactgttttctcaaacagtgccggctgcgttgccagagcaacaaccagagtaccctcctcgatcagagaaatggtgccgtgcttaagctcaccggcagcgtacgcctccgaatgaatataggaaatttccttcagcttgagcgaagcctcgagcgcggcggcatagtccagcccgcggccaaggaagaacacgctcgaacggttcgcgtacagcgttgcgatgcgctgcatatccgactggcatttcagggtctgctcgatgcactccggcaggcgctgcagctcagcgcagagcgcacgctcgtcaccgatggagatgaggccgcgcacacgcgcgatcttaaccgagatgaggtacagagcggacagctgtgcggaatatgccttggttgtcgcaaccgaaatctccgggccggcccaggtatacagcacaccgtctgcttcgcgcgcaatcgtcgaggaaacgacgtttacgatcgcaatcgtgaacgcacctgcctgcttggccagacgcatggcagccagcgtatccgccgtctcgccggactggctgataacgatgcacatatcctttttgccgatgatcgggttctcataacggaactcactggcaacctctgccgtgcagcgaatgcggcacattgcctcaatcacgcgcttgccgaccatgcctgcgtgcagtgcagagccgcagccgatgatatggatatgctcgatctcacgcagacgctcgtcggtcagaccgttgtcctcaaatacaaccgcatcgtttttgatgcgcggcttaaccgtatcggcaactgccttgggctgctccatgatctccttgagcataaagtgctggtagccgcccttttccgctgcggacatatcccacgttacggtcatgagttccttctctaccgtatcgccgaactcgttcatgacaactacgctgtccgggcgaacgattgcaacctcgttatcatccagaataatataacgcttagtgcgattgataatagcggtaatatcggatgcgatcatgttctcgccctcaccgataccgataaccagcgggttgccgcggcgtgcagcaacgatctcctgcgtgttatccatcgagactacgcccagtgcgtaagaaccgcgcagacgctgtacggcctgcagaacggtctttgccagatcctcctgcttgccggtgtgcagatagtccacgaggtgcgcgacagtctccgtatcggtctcggacttaaactcgtagccgtgtgcctccagacgctcacgcagctccttgtagttctcgataatgccgttgtgtacaactgctaccttgcccttgccgcccagatgcggatgcgagttgcggtcggacggctcgccgtgcgttgcccagcgggtgtggccgataccgcaggtgcagtacatgtcgccgccttcctccttgatcttctcctcaaggtttgcaatgcggccgcgcgccttgacaacgcgcagaccgtccttcgtgaaggcagccacaccagcagagtcatagccacggtattccagactgtacagacccttgatgagaatcggaagcgcgttctcgcgtccggtgaatccaacgattccacacataaaataatactcctttgcgacggtaaatataacatatcttccgcaacatttcagtatgagccttaggcagcacggaacaatgaaagctgtggcttcttgcgcgaactccggtcgcgccttgtcggtccgcaaaactctctcacaaatcgctcttgtttcattattccgtattgccttacctcaatatatgcggtggtacttgtgtaataagaaattggtgctaccgggcaatttggcaaaagcagtttgcgaaagattttgcgttctgaagagcgtaaacgattcgcaaagtgccgcagacaaattgtgcggtagtgccctaaaaaagggtataaaaatagtgcgttacgcataactgctctgtcgatacggtcgcccgtatgttttaacagcctgctgacgatcaacccacttgtgaccgaagggcacccgccgaatactttcgattaaccctttcctcgtcaactgcgataccggctgcaccgcagttctggcgcttagcatgttatggaattgtgcgcaaatgctcccacctccctgttcagaatgcagaaagtgggtgtgcaaaccacacccactcccgttggctcttttatattatacaacagactcgatgactttggcaaccttttttgccaaagtatctacctgctcactattcgtgccctctaccatgacgcgcacgagcgcctccgtaccggacgggcgaaccaggattcggccgttattgcccagctctgcggaagccgcatcaatagcctccttgacctcgggcatctgctgcagggtagccttcttatcgttcggcaccttgacattgatcatcagctgcggccacggctcaacctcagctgcgatctccgagcacttcttgccgctcgccttgaggatagacataaactgcagtgcagtcagctcaccgtcaccggtggacgcatactcaagaaaaataacgtgtccggactgctcgccgcccagaatgtagcccttcttgagcatcatttcgagcacatagcggtcacctacattggagcactcgatcttcatgccgttcttatcggcgtaggcgtgcagacccatgttggacaaaatggtggcaacaaatgcgccgccgcgcagcttgccttccttcttcatatgtgccgcgcagactgccataatgcggtcgccgtccagctcctcgccggtctcgtctacgatcaggcagcgatccgcatcaccgtcaaaggcaacgccaagatcaaaattgcccgagcggacgcgctccttcagctgaccgagatgggtggagccgcagttatcgttgatgttgatgccatccggctcatagaaacggatttccgccttgcactcgaccagacgcatgaggcgctccaccgttgtggaggaggaaccgtttgcacagtccaccgccacgcgcagaccggacaggtcgcccttgatggtatctgcaaggtggtcggtgtactcgactaccgggtcgatctcgcttttgagtacacggccgatcttctcgtgggtcatcttcggaatagactcgaaatcgtcgatcaggtcctcaattcttgcctcggtttcgtccggcagcttgtagccgttgcccgcaaaaatcttgatgccgttgtactcaaaggagttgtggcttgcggaaataacaatacccgcatctgccttgtgcttgatggtgaggaaagcgaccgccggcgtcgggataacgccgagcagctctacatccgcgccaaccgagcagatgcccgcgaccagcgcgttctccagcatatccgaggatacgcgggtatccttgccgatcagcagcttcgccttgcggccgtgtgcagactcctgcgtaagtgcgtatgccgctgccgcgccgattttgaacgccagcagtgcatcaagttccgagttcgctacaccgcgaacgccgtctgttccaaaatatctacccaaatgaaacacctaactttcttatatgataaaggcgggaaaacgattgcattacagcatttgctgtccgtccgccggttccagattcaaatgacggtaagcctgcagcgtcacgcagcgtccgcgcggcgtgcggctgagaaagccgatctgcatgagatacggctcataaacatcttccaaggtgatcgcttcttcgccgatggtcgcggccagcgtgtccagtccgaccggaccgccgccgtagttctggatgatgcttttgagcatcctgcggtctacattatccagacctaactcatcaatctcgagtgcacgaagcgcaatgtcggcactttttctgtcaatcgtaccggtgccgattacctgtgcaaagtctcgcacgcggcgcagaagccggttggcgattcgcggcgtaccgcggctgcggcgcgcaatctcgaatgcgccctcgtgctcgcacggtacatcaagaatgcctgccgagcgttcaacaataccgcacagctcctccggcgaatacagctccagacggagcatgacgccgaagcggtcccgcagcggactggtcatctgaccggcacgcgtagtcgcgccgatgagcgtaaatttcggcaggtcgatacggatcgagcgcgccgaaggccccttgccaatgatgatatcgagtgcatagtcctccatcgcgggatagagaatctcctctaccgcacggtcgaggcgatggatctcgtcaataaacaaaatatcattctctgagagatttgtcaataaagccgccaaatctcccgctttttcgattgccggaccgctcgtaacacggatattcacacccatttctgcggcaatgatgcccgcgagcgtggtcttgcccagacccggcggaccgtacagcagcgtatggtcgagcgattcaccgcgcattttcgcggcctgtatgtaaatgctcaggttttccttggcttttttctgaccgatatagtccgccatggatttcggacggagcgaattctcggtctcgtcctcgctgagctggcgggtggagatgatgcgctcatcatccgtcatgccgccggaaaattcaatactcaaaggtacactcccctacttgatcaggcttttatcgtccagaatcaggacttgaccagctttttcaagcactgacggatgatctcgtccgcctccatgccggcagcatccagaccctccatcgcgtgcagcgcctctgcctgcgtatagccgagcaccataagcgccgcgactgcctcctgcgtgtggttgacaccgccggaaacggcggctgccgccaccggagacgctgcagatgcggtctccagctgctccttgctcatcttgtcgcgcaactcaagtacaatgcgctgtgcgatcttcttgccgatgcccggcgcctgcatgagcattttttcatcaccggtgataatgctgagcgccagtctgtccggcggtgcgaccgacaggatggacagcgccgccttcgggccaacaccgttaacgctggtcagcatcaggaaacaggacttctcttcttcgtcgataaagccatacagctcaaacacgccctcacggacattgagccaggtcagcagacgcgctttttcgccggttttcagcttgccgatggtgttctgcgaagtgtggcaggcatagcctacaccgccgcagtcgatcaccgcaagaccctgctggagcacggaaaccgtgccgtctacataataaaacatctatttaaacctcataataagccttcatagcgcatggcctgccgggaatgcccgtggcagatggccagcgcaagcgcatccgcggcatcgtccggacgcggcagcttggtgagatggagaatgcttttcgtcatttccatcacctgttttttctccgcgccgccgtagccgacaacggacagcttcacctgattcggtgtataggataccggatgcagtcccttctgtgccagcgccagcagaattacaccgcgcgcctgcgcaacctgaatgccggttgtgacgtttttcgagaagaaaagctcctcgattgccacctcgtccgggtgaaatgtgtccaccagcgtacagatatcatcgtaaatctcacataagcgcaggtgcatcggtgttccgggagcagtttttgccgcaccgtactgcaccggcgtaaatttcatattatcgaatcgcaccacgccatagccaatcgtgccgtagcctgggtcgatgccaagaatcgttatcatttctttataacctcaaaattataccacgttcgcacacattgtgcaataaattttagtggcaggttaatggaaaattgagaattgagaatggagaatggaaaatgaaggtgtccgcccacagggcggtaattaaataacgcgctttgcgcgcaacctcaattctccattatccatttttcattctcaattcttcttccgttggcataaccgcgcccttatgctgcacggtatacgccgaacattcagacgaaaatgtcagataatccgcaagtttctcctgcgggatgtctgcgagcgtttccgctgtcacaccgtcgcgggtaagctgatacaggaacgacccgatgaacgaatcgcccgctccggtggtatccgcgaccgtcaccggcagcgctttggtctcggcgctcgcgttcggcgtgtagactgccgcgccgcccgcgccgcgtgtcacaagcagcagcctgcagccccgcgaaaacagaagctctgccgcttccctctcggttttgcagccggtgcagaattcaacttcatcatccgacagcttcacgaggtctgcatacggcagaaactcacgaatcgctgcctgacagctttccgggctgccccacagcggcagacgcacgttagggtcgaatgagaggaacgcgcctgcgtcctttgccagccggatggccttgcgatgtgcctgcttgacaggtgcatccaccagatcgaccgagcaaaagtgcagcacggcacagtccgcgaaaatatccggcgtgatctgtgcttcatcgagaaacaggtctgccgagggattgcggtagaaggaaaactcgcggttgccgttcttatcaagtgaaacaaatgccagcgcggtatttgcccgtccggtgcggaacaccgttgagatgttcacgccgtttgcgtgcagcgttttgagaatgtgcgtaccgaatgcgtcctctcccacctgcgaaatcatctgcgctctgccgccgagacgcgccactgcggttgccacattggccggcgcaccgcccgcgacacgctcaaactgcacgacctcatcaagtgcacagccgcgctgctgcggcacgaaatcaatgagcagttcgccgattgccactacttttttcatcgttcatcccccagaatatgtcggtaaatcgcctgtgcgacgccgttttccgtattgctgccggtgataacgtccgctgcttcgcggatgcacggctcgctgtttgccatggcgacgcccagtcccgccatctgcagcatggtcagatcgttttcgctgtcaccgatggcgatgacgttggccagcgtgcagccgaggtgatgcgccagccattccagtccgcgtcccttgtgcacacccacgcggttgacctcgacgttgcgcagctctccgccgtacatgacggacggcgcaagctcgaaaataccgtatttatcgagcgcagccgtcagcggcgcgattgcattcgggtcatcgtgataaagaatcgccttggtgaacgggcgcggctcgtctgcgagcacagcgcgccacgcattcttgtccttgacaaaatgatagccctcatcggcttcgtccatgacaacccgtccgcgccgctgcagattctcgagaaaatgccgaaaggcatgtccatagtacaaatcctgcgtggtatacaggcatgggtcggtgtcaatggcagtgcactcgttcaggatgatgtccaccatttctgtgctcaggccgtcgaaaaacaccggttccctgtcgtccggatgctgcactgccgcgccgtttgcggtgacaagccagtccggtgcggcttccagctgttcgctgaagcggcgcacctcgcgcacgttgcgcccggtgcacagcacaatctgcacgcccgcctgctgcgccatgcgtaccgcgcgggcgttctccggcgtaatgcggctctgcgcatccagcagcgttccatctaaatccaatgccagaattttgtattgattcgtcatattcatactcgtttcctgttctcattcgcgcagcatggcacgccgcgcacgataatcgggtaaatagcgctccaccagcgcccagaactgcggtccatggtttttatgtgcaatgtgcgccagttcatgcaccaccacatagtcgatagcgggttcgggatagtccatcagccgccatgagaagcaaatactgtttttgccgctgcacgagccgaaccgtgttctcgctgaggtaatcttcagtccggtcgggtacaggttcatcagttttgcgtaatgctgtaccttgggcggcagctctattttcgctcggcggataagctcagcctgcttggcctcatccggctccggatgtgccgcacggcgggactgctgatcggcaagtgcgcgggctatccagtccgtatgctccgcgacaaaccgttcaatgcgatattttgccagccgcagcggcgcacgaacgattacacggccttcgcgcgtcacctgcacagcaagcgtcttgcgtttggagcgaaccagttcgtactcgatcatatcattgtcccttgcgctccagattgcggttgtagaagaacaccgcgaccgaaatgccgcagatcagcagatagccgaggacgctccagccgtccggcagctggccgaacaggaaaaagccgaggacagccgagaagatgacctgcgtgtagtcgaacaccgaaatctccttggccggtgcgttggcgtacgcgagcgttacgccgaactgtccgagcgcggctgacgcacctgcgccgatcaggcagaagaactgtccccatgtcattgggtggtagtccgtgatcatagccggtacgcataccagcgtggagaacatcgagaagaagaacacgatgcgggcgctcttttcgcctttccggctgagtgcgcgcacacaggtgtaggccgcgcctgcacccatgccacccagcaggccgataattgccgggaaggttgccgaggaaaaacccggcttgataatcagcatgctgctgccgaatgctgcaagcaccgccgcgtactggaatacgctggcccgctccttcagcagaatgagcgagaagatgatagcgaagaacggcgacattttattaagaatgtttgcatctgccagtacgagatggtcaatagcgtagtaattgcagaaaatgccgagtgtaccgcaggttgcgcgtatgatgagcagcggcaggttgcccttttcccacttaaaaccaaccttttcgcggcacagcaccacggcggccactgccaccgcgaccagattgcggaaaaatgttttctgcgtgaacggcagatcacccgccagacgcacgaatgccgccatcatcgcaaaaccgaatgcggacataatgataaaaccgattgccttactttttttagaaagcactgaagtcttcctccttttttcgctgtgagttttctgactgcttctattgtaacacacaaactgtttcgcgtggcagagaaatcgtctgtttttcgcgttttgaaatttttcaaaaaaatttgaaaaaaggtgttgacatttggcgtccacatggatataataattcttgtcgctgacagtgaggcgactcgatgagaacagaatgcgagtgtgctggaactggtagacaggcacgtttgaggggcgtgtgtcgatcgacgtacgggttcaagtcccgtcactcgcaccaccttctttcaacaaccaaatatgcggatgtggcggaatggcagacgcgctagcttcaggtgctagtgttcgcaaggacgtgggggttcaagtccccccatccgcaccaagaattgtgctgaaatcattgaatttcagcactttttctttatctttgttgttccagtttttaactgacgacactttgacgacaaaaggtggctcttcaccccttatgcataggagaaatttatatgtttaccattgagaactttgcacgtggcattactaatgcagtacgcaatttaaatgccgaagtaaaaaatgatactcttgttattacgaaaaatacttacgattatgaaaagagtgaaattttcccgaaaccctttgcaaaaattccaacatcggaatttcaatctcttttagaaatatttaagactgattatgatattcagattcctatggttgccataaaaaaatgttttgaaaccgctattcaatctcagcacattcatagaccatcgtcatttgtatggccaactttagaaaatttggaaacgagtgaacacaactatcacttcactatttcacaggcaagccaacaatacctcttcgctttgttttgttcatttcataattgttcagatcaatatgatattactcctatgcgtatgcgctcgtccatgcggattaccgaagaagaaattgtagatatagcagatttttttaacatcttcaatatgcataccttaaagatcacctctccgcaagaacactctatatccgaatttaaatgtatcttcgacgcatatatttttaatattgcacataatttaaatatttcccttgctattgcagattttgagtctgagcgtgcttcccatattcctaggcacacgcaccatggtcagttttttccttacaaaaaatacaaacccgatttaacaaaatattatcatcaagccatttctagcggtattccatttacacaatacttagctttttatcatgttgcagaatttttctttcaaacgatttcagaagatgaggcattccaagtaattcgcgattttattacacgtccctccttttctccatacagccaaaaagatattcgaaacttctacaaaaccataaaaaagaaaatacgtgatcaacgcgacaatggtgtttgggatgaacaaaatggtctactactgtgcttaaaacggtatgttcccagcttatctgatctcaaaaactccatcaaccgcattgacgatacctctgttaattattataagactacagcagttcctttcgctgacaagggaaacactatagattttgatactgaaccagaaaaagtatacgctgcgattcgtaatcgaatctatgctactcgcaacgctattgtgcacagcaaggaaggtgaaaaatcaaaatatgaaccttttaagcatgataaacaacttgccaaggaactccctttaattcgagcagtagctgaagaaattattatcaactctgctgaacctatcaactacaattttaccgaacaataaaaaacagcccctccgagagccggtataaaaccagttcccagaggggtttcgctttacttctgcatagccgctgccagtttcttgaccaaatcctcgccccactgatagcggagcaggtactcaatcgtctgtttctcaaggccggcactctcctgcagcgtatcaactgcggcctgtacagcctcatcgccgtccggtacaaaggcgcggcactgcggtgcggtaatgctcggcagcttacggattgtatcgtagctgaccgcaaagcctgcctgctccagactgcgcatcttgatgtagtttacctcatctttgcaaatgcactcgcaggtgtacgtcttgccgttgagcatgacgttcttcttctcgaccatttcaggatccttccttgctgtatccggctcggcgtacttctgaacttcgttccacgggaagtttacgcccgggcagtcggtctcgtttacatctttgtgccgcagcagcttgagcttgccgtaccggctcatgatgtcgcggatgaggtccttgagcgcagccagctgtgcggcgggcatggtttccaccatgtaagcgccctcacaacagatgccgatggacttgtcgttgtgcccctttgcatgggcgccaacagcccattcaggccgtccgcgccagatggtgccatccttgcggacgtagtagttgtagccgataccggcccagccgcgctcgagatgccatctgttgatgtcctcaacgctggcgtgcgatgcctccgcatggtgcaggacaatctcggacgtactgttgcggtacgaccagttgccgttgtgctttaagtttgcgtcatgaatttgcattgtcgtcctccttgggtactaccctgtcccctgcggcatctacggccttgcgggccgcgttcaggccgcgtacgaagatctccggtacatcgtaaccgagcacgaccagattttctacgatgctggtcagctcattcagaatgtacacgccgagcgtaaaccagccgatcagccgcaagaagtccagcggtgcgccgatctcagcgccgaagtcgatcagcacctgcgccacaccgaacgccagcgcgataacgacccagtagctgaccttcttcatcacaccgactgcgccctttgcgctgttcaccgtaccggtctgcttgcccttgagccagccgtagaaaaagtccacgacattgagcacaaagaacagcgcgaacacctgccagtgtgcgccgaacacgccgcccagtgcggcgactaccgccgcaccgagcaggtttgctttgtccgtaaagacttcgagaaagtgctccatacgctcctccttactccgcctccacgtcagccgtaccgccgaactccgcaggtacaagctccggcataccgcattcgtcgatcaggatttccgctacctgctttttcagcttcgcgggcaccttatcgaagtcacacttacccaaaataactctctgtgcaaaaagcattgccatcataataaccgtcctttcaaaacgttcttgaatgttgttgattaacttacgcataaacgacttctgccatctctgcaatacaatcctcataaaaagactgctgatcggtcgcggcgctgacctgcgccttgagcagcttgttctcctgttcggcctgtaccagccggtcagagatcgtgtccagcgcggccgctgtgccgtccaccgcacgggtgtacactgcggtgacactggtcggatcggcggctgcgaccgtggccgtcttgagcgcgtaccctgccaacacctccaccgtatcaccggcatcggtcttgaccgtgagcacggcagcatccagagccagcacggcctcgaccgacgtatccgcaaacgggatcgtcagcaggtcgccgtccgtccggtagtccaaggctttcacatcgttgattttcatgggttcaccctttctgcggctaattcgccgcaacatattttgtatactggtgcttgaccgtttcgtcgttcagctcggcataaatttgcgttgtcgccacgtcctcgtgaccgagcagccgctggataacggttacgtccatgccggagttcaatgcgtgcgtcgcaaaggtgtggcgcagcaaatgcggatggacgcgcttatccagcccggcgcgctcactgacagcacggatcagccgctgaatggcacgcggtttgaggggctcatacggcgatttgctgctgcagaacaatccatcacctcccttccgcgccacgaaatactcttgcagcatgagtcttgtgcggacgctgaaatacaccacgcggtccttatcgcccttgcctgtgacctttaccgtcctgccgacaaggtcgagatcggcggcacgcagctgcgcgacctcactcaggcggcagccagtggacaccaaaaattccacgagcgctttctccctgtagcctttgcaagcgtcgcgcaggcgctccaattcttccacggacagcgcctgccgtgcgccttttttgtccagcttcaaggacttgattttgctcatcgggttcttcttgatcttctcctcggtgtgcagccaaccgaagaacgcgcgtaaagtgttgatgtgggtttgcaggctggtttccttcaaatggcgggtttcatcaaggtacgcaatgtagccgcgaatgtcgtctgtggtgattttcgcggcgctcttttcgaccttcgccgcaaaactttcgaggttcgctttgtagtttttgagtgtccgctcggatagcccgtcgatcttctttgcgcccagataatacttgatcctgcggcgcaggtcgctgcgtgtctcgtcgctttcgcgcgtgattgtgtagcctttcagcaggtctgccagcgtttcctctgttatagcgtcaccgcccgaaaaacttccgagaagccgtccaatcagttcggtttttgcgttcaaatgtgtttgctcctttcaaaatttgatgtatggacattatacatcaaggagcaaaaagcgggcaatttaggacgcattataccgctatgacggcggtggcagcgtcttctaccgctatggcggcggtggcagcggaaatttgtatgcgtaacctgcatttatcgcggcaagaaatgttctctttgcaaggactgccataagaactgccctgattttgttgaagaagtatgtcctaaacttttgaagccgccgtatatctgtaccgcgtgtaaagaacgttccaaatgtacattacgcaaattcgaataccatcccaattacgccgataaagtataccagcaaacacttggagaaagccggcaaggattttcagttactcctgaggaattagaacgtatcaacgaaatcgtttcacccctcatcaaaaacggtcaatccattcaccatatctggaaaaacaataaggacatcttgatggtcagcgagaaaacactgtataacttgctaaacgccggagctttttcagcaaccaaattggattgtcctcgcattgtaagaatgcgtccaagacagaaaacgcctgctcccaaagtggacaggcactgctatgatggccgtacttacgacgactttatacggtttatggaggaacatccagacactccagttgtccagatggattccgtaattggtcgtaaaggtggaaaagtcctgttgactatattctttcagaactgcaatctattgttggcatttctacgagactataacacggccaggtcggttactgacgtttttgaagatctttatagccgcttaggacatgacgattattataggctatttcccgttatactgacagatcgcggcagtgaattcagcaacccgactgccatcgaaaaagacgctgacggccattctcgcagccgtatcttctattgcaatcccagtgcaccatatcagaagggaggaattgaagtttcccacgaattgattcgacgtattctgccaaaaggcacttcttttgataatctccagcaagaggatattgaccttatgctttctcacattaactcatataaaagagataagctgaacaatcggtctgcataccaactgttcagctttatctatggtgagtctattttgaataaactcaatgtacatgagctccagcccaacgatattgtcttgtccccgaaattattgaggaagtaacacactaataaaacaaccctaatatttcagattcattccaagctctcaggggtggaatttacctttacaaaaaataaacggtaattttcacctctgggagttttacgcctttttgctgaaacccatgcttcatatcttatattttaacaggtattcacggtttgtaaagggattttgcatagatttatcagactaatttccaaatcaaggtgtccctatggaatttagtcttacaaactggaatttacttttacaaatgagcagtggtcgagacttgagtttgcatgttgcaggcctccaattcttgttggatcattaactcgacgacttgcaggatgcgcttttgggatgccgatgggagcactgacagcttctccgatagaacggatgacatgtagtttggcgagtgatccaacacatcacagaaaacggcatcggccgaaactcccaatgtgttaagaagcgaaattaggctttcgcagcgcggaaaagccgtaccgcgctcaatcgtagagatgtagtttacggtaaacccggctttttcggcgaattcgctctgggtgagaccaagagcctcgcgatattgcttaaaacgttttccaattctgttatcgatcatgtttttctcctttgggattgttggcccactggctatatcttcccctcttcatagccttccctatcaaagttttggtgccatccgggttttcgagaaatacttctttggtttccagagcgaatcgggcaatgggcagcttgtgtaagcgcttgtattccaattccgtctgcaccgcgatttgagccgcttgggtaattatattctttttcgacatagttttataccgtccttccgtcttgtaccgcgtatctcgaattagcagcgttcgttttcgaatactttttcgaaatcgaaaacggtcggcgtaagattataatgtgctctgtatagcgaccgtatcagaatccagcgcctccaatgctgaaggcaggaatatactgtgcgtggcgacaaatatctgcacaccttcctgctgcaagaaacagagaatttttgcaatgagcgaaatatatttcagacttactcctgtgtcggggttgtcccacaacaaaacggaaccgttcttaagagtaccttttttaagcagaaggtacaacacagcgagcttttgtaggccttcggcaagcatattaagttctatgcgcacatcattgttcttgagtacatagaacttttcgttccggacgataactttgcccccgatggcattttccaattcaagcaacaacgactctgcgtgattgctgacatctggagatatgactatttgggcagcagcaattatgtccaaataggtatcatcgaacataacatttctttgtctgactgcttgctcgaggttccaagcgtgtggaagcatattgacggcaggaataaagacacaggtcttcggacagtattcttcttcccacatctgatcgcagtgttctttcgcttcccactttggtgtatcggcagtaaaagaaacacaaatggaggctgtctccgaacatacctcgactttggcgagagcatcggacggagcatcccaattaaccaatttggacaagcagttcccttccggtcggaaaacgcgagtcgctttgtactgaaaagaattgccgggatttgcagcttgcactgctgcataaagccatttgaggatttgtgtcttaccggatccgttacctcctgcgaaaatattgattcccgggcaaagagaaaattgtttttgagtaaaaggaccaacattctcaagcgtgattgatgttaatgacaaaatatgagcctccctctataatccttttcgtgtgatagtattccgtatcgttgtaataattgtatcacacgcagcgtgtgactgcaacaaatacttttgggatgaaacggagagcaaatatacatgttgaattttgtcggtagcatgtacgatgatataatccaatccttgagagacactaagtcattcactggacgcatataacaagaacctatcgatgcggtttttccaattactcatatttttttgctttaaccgcaaaagagggatatgatttctctggcagaaatctgttttgattttgtcgtgcttccgtgttttttgaaagctactatctccaccgaaaattttaacgggctgctcatgttgttgcccatccgtttcgatacaacatattttctttccaagataaaaagcaaaatcgaatggaagaggattaacatctctgcaatcatcgaatttatattgtaagattgggaaaatacctttttcggacagtaagcgatagcatagccgctccgtggaatatcgcaagcatttatatgttcttcgggaaaccatttcttgaattttatctcgtgatttttgcgaaacaaaacatcttgaacagagttgaataatttgttgtaagattagtattttttcatcatccgtttgagttaactttatttcatccacacggaatgtatcgcttaacgcgcgtaaagcacaatagataatagctattttgtgcttgtctatgctatagacatactcagaacacactgctctactgaggacaacctggagagtatgcagctgatctatgcttctccaacatggaacattttttacgtaagataaaatgagattattaagcgtttttgagatttcctgaggaacaaattcacgactgattggatcttgtatcttatacgcgatgttttcctttgcatcaagagtgattttcttaacttggtttttatatagcccgcgcacattgatcaggtcttcgaacaagaaacaaccagataacgatattgctctatcccttcgtttaatggattgtttgagcctttctatatcatcattataccgttgtaacgaattgataattgatcgatattgtaaaggaattatatcattatagatatgaagaaaatcaaagctatcaggaatatcattagtataatatttcttgtttttcgtgaaagaattagtaaccacagttacttgctgttcagggaacatttcttctgtaattgaaattccaaatctcaaagcaagtggaattaaaatgttaccaagaataataggttttgtttcagaaagcaggtttgtgaatcctaattgttcaatctgaggaacgattcttgctgtccattttatttttccaggaatatatccgtgggtgaatacttcacggacacgacttacgcgagataaagcataacagccactaccccgataaacattaagaataattggaataaaatctataattttggggtaacggattgtttcctcttgaaggatatctgctatattaagagacaacctataccaatcattggcagaaccagaaaaatattctcgcgtttcttttagaattttttcaaacttggtcagatcggcctctatagcattggttaacgccataattcgaaactccttatatttcaagtgacaaatctcgtatcattgtaatgattgtaacgcgtgtaatgtgtattttcaacaaatactttcggggtggaatggaaagcaaatatacatgtcgaattttgacgggagattgtgttataatgtattaaagggggcgtgcaaatgttcgctgatgctttaattgagagcccggagcagctgagtctgtttgaagaactctacaacacttattctcaaggcatgttttatgatgccagaaattttacacacgatatccacaaagcagaagatatggtatctgaagcattccttcgtgtggctaaaaatatagatacgatctcaaaggtgccgtcagaaaatatgcggaaatatctacatatattgatacgaaatatctgtattgacgaacgcagaaaaagcaatcactcagaagaaatgtatgaacagttttcagatgtcgctggtacacactcaactgagaatatggccataggcactgttgcaatcagggagatcgcagacataatactggggatgccagaaaaatataaagacatattgctcctggtgtattactatgaacatacggtagaagaggcgagtattgcaatgggtatcagcgcgaatgcggcatatcaacgactatcccgtgcaaagaagctcttaaaggatgtcttaacaaaggagggccagttatgaccgagaaggatttcgataaactgctcagtgtggcaatggttcacgttgcagaagaggatgctagctctcccttaaaaacaaaagatgagctgaaagtagcaggcattcctgaacacaagttctctcctgagtttgaaagaaggatagccacaatcaaacgaagacagcataacccggtatatcggtggctttggaaaagaaagaaccagttgattgcggccattatgggcattgcgatattgggtggaactgctgtatgcagtgttgatgctgttcgaatgcctgtggtgaattttttcttgaggtttgataattcgaattctcatgttatagcagacaaagattccaatacaggaataggcaaaaaatacttagcttatatcccttcgtatgttccagaaggatttgatattagccataaggatgaatcgccagattatataatgatagaatactcgaatggaaatggttcatattatgatttgacgtgttcactggatttcgaaagcaattctgtcgatactgaagatagtacatatgaggaagtcgttattaacggtaaaaaagcatatttttgcgagaaagatgaccgtttgcttgcaatatactatactgatgtttatgcttacggcatttctggcactatatcgaaagatgaaatcataaaaatttttgagtcaatttaaaagtttttgtaagaacagccgttcaaatctcgtctatagtagtaaaaggaggttgttcttatgaaaaaagctatccgttcatttaccgcagtgatcctcattctctgcacaacatggatctgttccggagcaacggcgatcaacccgtgctggaattacgtgacgattgtcggtgggcacattgacattccgtcttcaatccttggtattgcagaagtgcggggacatggcagcgcatcaacagtgggtgttgataatgttgtttgcactgtgtatttggagcagatgaaggaccgcaaatgggtaacggtgaattcgtggaagtctgcggcacgagctcgttctgcgcaggtcagcactaagaagtatgctgttgcacatggttactcttatcgagtacgagtaacactggctgcatataaaggcagcaagctgttggagaccggcgagtttacagaatcctatggatactttaattgatatttttgaataagcaaaaatgagagtattctgttacggtggttgaaaacaaaagcaccgggatttcagattcaaaagcaactattgtatcgagttcctttagctgtaactaaaacatggcaatataaagatgcaacgtatcctatttgtccacgctgcggcataacgatagaacgtgaatatgttgcgttttgcagtcagtgcgggcaaagactatactgggaattgtttaaaatcagagaactcgcaatcctggatttttagagtttgcgataggaatacatgtatattatagggagcggttgttgcaaaatatgcagcaaccgctttatccattagacgaagaaagaagatgagtattttctgttatgttttttaaagaaaataaaggcattgtttatgcgtgtagataccgtattgtttggtgcgtaaaatatcttcgcccagttttaaccgatggcattgacctaagactgcaagaattgctatgtgacgtgtgccagcagaaagaaattacgttgatcaaggttcatgtggagtccaatcttgtggacttggtaatcgagttaccgccacagcatggtgttcataatgctgtaaagcaaatgaagcgatatctttcacattgcttacgccaggagtttcctgctttgaaaagtcgccttccgacgctttggtcaaatgcgtattttattacgacatgcggccgaatggggaaaaattattatgagatgatgcaggattttttgcagcggcagaaaccctgtaaaaacaacggaaagaaaaagcagccttaaggctgcttttttctatggattgcattttttacaaggctcatatccttgagcgatgacttcatcacggcttcccgagaactccttcttgttggagtccttcatgcgtttaatactgctgcatgagggtatgtggaatttcttggaatttgtattcaggataaaagtagagcctgaactggtaggcgaagatgcatcttgctgagccgttgcctggttcgtttctgccactgcagccggcgccgtagtggtttgtgtggaggatgaagaagtattgttgcttgccgaagaagctgtagtgttggtaccatcctcgtggctttcacccgttgcatagtcaatagtgatacctggctgaacattatagcagaagacgttgaactcaataccctctcccctgtcctcgacggacatggcctccatctgtactccgttagcaaccaggttgttaccttcgaagattggggttacgcgatataggacgtgatgattatttgtttccttgatgtagtcagcaaccatgttctcgaaaggaagcatgccagttacatttaggtatcgtgttccggtaatgagattcttcacgttcgcgttctcagccgtgagttgaaatcccaatagatggcaacgattgtaaagatattggccatctacgtggctatacttgacggtatgccaaccagttggcttaacctgcccgatggaaccacgctcttctgtaggcatcagatcctgcccgacgttggcaaacgctacgccgcagcggccgagagagtctaactcactataatgctcaaatgaggttgtcgtgaaatcggagtccgtaaaggccggtatattattgttgatgggcacatatggttcgcccgaatagacaggaagatcactgatatcggtgctgtagctagaactatcagtaggtagcgtttgatcggaagcagttgtttctgcggtctctgtttgagattgggtgatgggctcaacacttgtggatgggggctctacttgagaagtggatccacaggcggtcaaaccaatcataaaagctacccataatgcgagtagagactttttgaggttagttttcaaggcttttcctccttattctttcgtgggcgatggattctgcttgagatatttaatcgtttcgttgacgatttcacgacgacagaacttgtggccggcagaggtaaaataccgaatggggattccagcctgtttagcggtgttgacagcgttccagaagcgggaatgcgacaggctatttacctggagccaaagtatatctgcattacgaatgacatcatccgacggcggtgtgtcttccgaaccatagtattgaatgtttttgtggaggtccagcatgccggcaatccaactcttgtgtccgccttcacatacgatgcgcataccatcaaatacactggtatcaagctcagtgtcagacgaagcatcatcataagagtttacaatctgctgctgaaggatcgagatctcattatccatagctgcagacgattgctcctggtttgcaatacgttcagacaaggaacgtacttttttcttaagagtctcattctgcgtctcgacagcagtcatatgctgcaccgtcgcttcgtattttgctttcaggttagacagatcgttctccaccttctgcgtcttatcagatttatcggagagcagcattgcattcttctctttttctctttggagagcctgctttagctgattgatttcttggtctttagcgcgaagcatatctttctgcttgatggcgttcaggatgtcagtgcgctcacggtcaatgagacggctggtatctgcgcaggatgctagctcatcaaaagacattctccagaaatcgtccttgggcgaagcttcgctttcgacagaagaatatctcatgtcagtaagagcagaggatacacctagtgatgctttcgagggagataccccctttgtatcaataaatccgtatcctggggcatatggatagcccaggttgtatggagataatccggagaacggtagctttgatgtgtgcatagcgtcccatagagttgcacggtcattgttttctcgcagaattcggttcatgataaatgcgcttgtttgatgagggttcgatggtccaacgccttccgctttctgaaagaatttaagaatgagcatattcttgtcattcctgatgacgtctgggatatctgatatatcaacggaatcaagagacaggctgtattggtcaaacttgttaagaaagaacgggataacaaggttagacttaccctgttcgcccatatcgtcgacaatttgctttgtggtcagatctaatgcctccctgaaaagctgacgaccggtatcaaaactgcttttgcggatatgcttagcaaaataattggcacgtacatcgacagccatattaccactcatcggaacgatccagtcgttcagggagagttcgtcttcaaaaacgaaatttccgcaaagagagagaagcttatctgcagtgcccatgtcatcgctacggcagctggctgcaacgcagtatgccagatagccgcccatgcgagcacggagcatgcggtccttcataatctttgcatattcgggagtatcaaaaaatgtttggataaatgacaaagagagcctatgatacttccgatgtacctgaagtttagcagctgaaatcagagtatcagccgtcttaaccggtcctatagcagcacttttttctagggcttcctcgacttgttcctgtaactcaacaggcattacaggcatgcacttcatcagacctcttcgtccttcaaaagaccccatctgtttgatatagttttcaaattcctgattggacattctacctttcacgggaatcacctcgttcgtttgatggctttattatatcactaattgatttacattgcaactgatatatagtaaaaaacagaaaaagctcaactcgtcattcactaaatagtgaatgaccaagttgggcttttgagatcaaacatctggcgatatgaatactatttcgtcaccaagggagaaagatttttctatcccgtatgggaatggaggtgtgatgtgctcaaggattgccttttcaacgagtttgttgcagatggatgccgtcagtgcaagactccacggggcgccatcgttggattgcggccactcgtgatcaagggctatttccttctttgcatcaaattcgtttaatacttgggataagtgctttcgatctatttctgctaaatcattaaggcaaatagcccatgaagtggattctccataaaaaccattggcaatactcggatatgcgttactccctgccgggaatgttgccgccatccagcgtgtcagcagggattccagttcgtcaatagacagagtaatggcgtgtggatatgtaaaatcatcatccgaggaagttgatgtgacgttctctttcggcgtaaggtgcggagaaggtttttgctgcgcttgcggtgccgactgagccagcttcccttctgattcagaagccggggtctcctccctcttcacaatatatggagtcaacgagtttagcgcgttgatggcctgccgcttaaccgctttgttccacatgattgtcaatttatccgggttcatgccgtacataattccatgtgtgacatccggaggcatttggtacatatcgcggggttctatctcctggagaagttcccctaccttcagtacaactgctgtcttagtgcaagcaacttgcataagagcttgtaaggttgggacatccgagctcaaggtcgatattgcataaaatgttttttgagcagccatggctatccctccccattagtaaaccacgtttttattctgtggcacaccaatcgtattaaagaactgtgtaatagtgtcgacttgagactcatcggtcgcggaagctgttacacaaacatcgccaataaggtcagcgcgataataaatgatcggatctgctgtggaatcactatcatccggctcggccatatagccatatacgcttctcggctggtcaagatctgagggtacgtatttctgagtgaactttccatccgctgcgccattgatcagtttgtcataatagaacagccaaaaagactctgcatcatcccggcttcctgaaatgcagaatgttgtaataccaccgttggatgcttgccatacagtagctcccggataattctcctggttgtaatcactcacatctgctgcgagcagattaaaggcactgaccgtgttttgatagttctcaaagatctgagttcctgtttcttcccattcggcaaaggatttgcggccctccgaattgacaggattgacgtatatcgacagatactcgttgatctcggcgaattttgaaaggatgatactctggagatcatctgaagatgtcttcatatctgtagcgattttggaattgcaaagtggagactccgatccaatgtcaagaacgccaattccatcaggcttaataagcatgatagaatcgcggtctgctaaatccatttgagtacgtaaccctttcgccaaagactccgaaggatcttcggttgtgattgcaatagcaacaacttgattgtatgcatttttccagttggcgttatacagctgtatttgcttctgggtatcttcagcaattagactgttagagtcctggatataagatgccatatcttcgggggtgaattgctttttttcagtttggacggctgatgaatccagattgtcctgtgagttgtttcggtgtatttgaaatactgctgcgctggtgcaagaaccggcaacaacaatcgcagcaatgatagctgcagccttcttattgattcgagccaatttcaatatctctccttggaagtgcataatttactattcacggtatactggtattataacactacaaggggagtatttccagcagaatcgaacatccaaaggggtagttgtttctaaagggaaacctcggccgttcaatgaccgagtagtttatgttttgtctttgttgtcgaatgcccatgctggcgattcgtcgctgatactcaagcttctagttgcgcgagacacaatggaatgacacgtagaaacaggaatgcctgtaattttcgcaatctggccatacgaaagaccatcctgacggtgactgagaaccataaggtcgcgcttgtagcgggctatagcttctttgagaagcttattttcatcgaattcttccatgggtactttttttctacatctccaacaaacgccatctggggatgctgttttaatgtcgtggcaaatgatacatggtttagtagcgcttttttcggcatagcgacacttagaacagagttggtcgggggaatttgtctgtctactatggcactttttacatatatacttataggttctcatgatttgaaatctcctcttctggcactgcagtacacctcttgcttatgagtatatattataccatcggcggggcttatgtcaaaccaatagagcctgttctgttgctttgactgaatcccgagctagttttgttcaaacacatgttcgcaactataccaaaaaataaaagcagctgggacatgcccagctgcttgttgttaatacggtaaagaatcctgaataagttttgcaaacgaggactcatcatccgttgcctgttcaggtacagtgaagccttcttctgctgtctcaaaatccctcattggatcatgggaggtctgcataggagcggatactgcctctgctgccgtgggggcaggtgcagtggtattttcattgggaaccgtggcttctcgcgtagcctgattttttgtatcattcttgggcggttctgggatgttgctataggtgaacgggacaataacaaaagaccagtcattgtataccgttaccacgccatccttttccaccttgcgtggcttctgcgggcggatattgaactcgcattcgaaacgatgtcctttttcaacgtcccggcagatgtgttctgcggtcgaaccaaaagccgtcagttcgtagaacattggctccggcacaattttggtgccatctttaccagcatacggcggcagattgactgctaacgatactgtgcaaaagctcttgccgctggctccgttattcatgacgggtttcttggtcacatgaccagatatataacctcttgctttctgaacaaactgtaacatgtaataacctctttcttttttggaatgaatgacttattgatgacttacttgttaattgtgggttaacacctccaaatgtaaaatatataataaaaaacccatacactcgtaaaaaagagtatatgggtagaaagcgaaaagtaaaaacagcgcttgtgcgcagaaagggacaaaataacaaagagactttatgtgtctattataataagtctacgttgataagtcaatagccaaaacgcaaataaaggttgcacgaaaaatcaattagtgatataataaacccatgaagatgctctgtctcaagagcagatatccgtggaaaggagaacgtagtggacagtattttgtgtaaagaatgtaaggaatgcttatttatcaatgctttacaacttataatacagtcctctactaaatataagaaatggaagataagaagaagtcaaggtttatctcagtgttgttattcctgaagaggaattttgggttatatggcggtatgttgatcgttatcatcctatttggatttatactcatggcggaagttgttccatccgcttctatggaacctaattattcggcgggcagtttttgcatcggcttacggttaggagataagagcactctggatcgaggaacaccgattttcttcaggcatgaagatgtgatcatgttcaaaagagttattggcctgccaggtgagacggtatctctgaaagatgggcatgtgtatgtcaatgatgaactccttgatgaaactgagtaccttgcagacgacgtaatgacctatccccggaccgatgaatctgtattcaccgtccctgaaggcacatattttgtaatgggtgataatcgcggagatagtgcagattctcgagcctgggaatattcttatgttcaaactgaggatataaaggctacatatcttttcggtttcaaaattcccttctggaataaactaataggcgaataatccaatagtaaaggccgccacactcttgtggcggcctttgtataccatttattccgaataaggctttcgttgcattgggttttgcgctcaaagcaaaacttccatgtaacgaagaactttgggctttacccgtagctgttctgcgtactgtatcagtttgcggagatccttgtttttggatgcagcatagcgtttcatggcatgtccgacaatctgaatatcattaccactgccgcgcagtatgtcacacagggtccgttccagattgtaaatacggattgggttaccggatggagacttgatttcggtttggccaaaatagtagttctctggaaccacacgcttaataaccacatcctctttctttaaagacgatgcattgtagcccttagggaaggtcattgtatatttcgccggggtacggtccgaatagcccagcagatacagtgctgtatcgtgcgagtaaattcctcgtccatacttgagctgcaataggtagaaatcatcttcccatgcgttgttctgcacatacagaccacggctgaaacgatacaactcaccactcacaaccagttcctgcaaaatactgcgatgcagccctgcggcggacacctgagctgcggtgacggtgccgtctttcgatgcttccagcagtgcttgtattttctctttcgcatccataccgttccccccttccctgttgacaatcgcacattatattatatagaaataatgtgtgagcgtcaactgacagagtgctatcctgcagcaattccaaggtcccttcaaacccaagagcagaaaaggtcgccacaaaaatagtggcgaccttttgtaatactcataccgaaacactttttccgtaacggacatagatcagagtcttatcggcaatcggggtctcctcgtagattgctcggagtgcatacgcataagtatcaagctgtgtcttatagtgcgcggatttttctgctttcatatcatcagaatccagatagtctgtcttgaagtcaataatatgaataccatcagcatcgacatagaacaggtcgataatgccttgcaagaggacatcatcatcggatgcttcttccccgaatacttcattaccaggagccaggacggagaaacgatattcgcgatggagctgatcggcgggcacaagtgccaactccttgccaaccttggatgtgaacagagtttttaacgccggaaccagtacagcatccgcttcatcaacagacaggaacttgccagacttgaggcgaataatttcctgctggatgccgtcactctcgttgacgcacttctggaagtctgcatactgcaagaacttatgggtggcagttcccttctctgcggccgagaaacctttcttcttggcgaagttggggcggcggattgtgacgttcctcttcaccatgctcaacgtcgaagcagcggccgctgccggggtatgaatggccttctggtatttgtattcgaatgccagatcattgcggatcttcgtagagtcaaggtagtcaaattcttcaaccggaagagaaacatcgtcttcagacatcatagaactctccgtgatttccgacatggttaaagtcttgctgtgcagctctcgtgcattgatgaccttgatattccaaggatatttgccagcgtgatactctgtggtatcaagatcggtcagtgcacggaggcattttgcttccggacggagcagcgaggagagaataatccactcacccggcgtgttgacgctctgagaaacagatgcagggagaggatactctacgtcagagagaagacgctgcatcgtacgagtcagcttatcgcagtacgtcattaccaggcgctgctttgcacgggtcatagctacatacaggacacgcagctcttccgattttgtctcaaccaaaatgctattggcaatagcggttctggcgatggtcgggtgacgatagcctttatccttttctaccagctgtacaccgacgccgagagtcgggtgcaggagcgtggtactcttgacgtcactggtattaaaccgacgagacaaatcagtaaggaatacgatcggaaactcaagtcccttgctggcgtggatagacatgatagtcacagcttcgtcttccagaacgcaagcagatgcctgcggaagctcttcgccttggtcaataagagactcgatatggcacagaaaaccaaagaggcctcttgcaccgcccatctcaaacgagctgatcatttcgccaaacttacggacgttggccatgcgctgttcgccgttactaagagaaccaaagacatcctctgcatcggtctcgaaaagcagctctgtgaacagatcgctcaatttgctgtacggagtcatgctgcgaagtcgtgccagctgggcaagaaacatcttgctcttgtcattgtcagccagaccgggcgtagccgcgtactctaccagagcgtcgtagaaacaggaagtctctttctggttaatgcggatatccgccaattcatcagcggtaaagccaaccagcggcgaggccataacagaaataagcggaatgtcctgcaccggactgtcaatgatctgaaggtaagcgtacagcgtctgaatctcagtggtgtccatgatggacttgttgcgagacgacttgcttgcaataccgaggtcagtcagagccttgacgtaatgcggcgcagagtttttggtagaacgcatcagaacaacgatatcgtttgcggtgatcggtcgcatctcatgcgtatcttcgtccatgatcgtgtcttcacgaagcattttctgaatgcgctgagcaacatactttgcttcgatatcgatcttggccgcactgccggactccgcagcgtcatcgtcagaggtgctctctcctgcgatatcttccatgttgatcgctacgagttctactgcgttgcgagagatctcttcatcctctgggaaatcggttcggccggcagccagtgcttcctcttcgttgtagttgataccgccaactaccgggctcatgcagctatgcatgacgtcattggttgcttcgaggatttcagggcgagaacgaaagttctggctgagaagaaccttgcgcggctccccttctcttgcctctgtgtaatccttgtaggcgttgtaatgcgacaggaagatagacgggtcggccagacgaaaacggtaaatgctctgcttaacatcgcctaccatgaagcggttgctgccggtactgattgcttcaaagatggtttcctgtacaccgttgctgtcctgatactcatcgaccatgatttcgcaatagttcttgctgatatcagcagcaacttctgtacgttcatgggtcttcgggtcaagcagtagatgaatggtcatatgctccagatcggagaagtcaacaacgttgttggaacgcttcttggcgctgtatctggtggtgaagagtttgaccagctcaaaaacgccgttgattgacgcttcagtcttactgaggtcgttaagcacagtgtcggacattgcatcaaatgcctgcaacttgttctttacggccagcttgtatttgtcgcgcagttccctgatgcgctctttggtcagaatagatacctgctctgtctttttaacaggcttcagacggccccatgcaacgtccttggctactaccatgtcgttccatgtcacagcacaggtaatgtcaaagagcttgcggtagtctgcctgcagcgtttctgtataggcagcgctcagtgcttcatcggcctcgcacagttcaatggccagttcgactaacggtaactgcgaacggatataggacttggcgttgtctatgagatatttaccccacggagtttcagccgcgtcagaaaacttgcgcacatccatattggacaggcactgctttacccattccatacgccacgggtggctctgtacagtgtcatatacgccatatgtaatggccggcaccgcgctgtcatcgcggccgaaagcaagttcttcgataaaagccttgatattctcgtgcttatcgagatttgcatagatatgctcgagcagatcttccataacatccgctttcataacgcggctctcctgctcttccatgacacggaaatccggggcgagatcagccattgctgcataggttcgcagcaggttagcacagaaagagtgtacggtcgagatctgagcaccgtaaacaagatgcatctggttctgcaaatgtttgttattgggcgaggcagcgagtctcttggataattcggcagtaatcttggcgcggagttcggtcgcggcagccttggtataggtaattaccagaaaatcagtaatgttctgattttcattgcatactcgctccataatgcgatctacgagcacttttgtcttgcccgaaccggcagcagcggccaccaacaaattgccgccacgatcagttacgactgctttctgttggggtgttaattcaaatttcttctccataaaactgcctcctgttcggactgttttcttaatgttattatatcactaattgattatttgtgcaacccttatatggatagttcacaaaaaagaaaacccggctgatcagccgggttgaggtgattatttttttggaagaccaacggttctgatgaagacgtctcgggatacccactcgaaacgattccaacgttctgatgtgcagatatccagagcggcattcataattgttttatcagaacgcttttcagtgggaataccgtactcacggacgaaattctgtaccttttcgagatattctgccccaaggatgcgttctaccgtcttaatggccaattcggtccaaacggaatccagaatatcgccgagattgcagacggcactggtgcggtacgtcaagcggcgtcctgctccctgccctttgtaggcggagcaaccgccgtgatagtggatattaagatctttgagcttgatggagtcaatgtcagggatgtccttgatactgtcaattttattactcgagaactgcataacttatcctttccgctgccctttcgggcagctgttgttactttctcttcgaaacttcttttgtgatttggttccaaaaatcttcttcagaaacctttgcgatgtagcgaaactttgtcccgcagcaatctttgtggcacgcacccttcaacgggcagtaccggcaagcgtttcgctccgggccacgagaaatcgggtttgcagcaaccttaccggttgcaatgttttcgacgatatcgcgcagcttatggacactgaactgattgagcgtatccagctgttcagcggtgcacacatcaccggaaaccgagccgtctttgcttactttgacattcaagtatttccgctttccatcctcatcagaatgctcagttgcttcgaggactttggggtcgttcagaagaacgcctcgacgcataagcattttcgtgcgctcaatctcaatcttttcgtcgctgaggcgagtctgagctgctacgagaggaaactttgcagggctgtagagggcaccggccggcagagaaccaccggtcacgatgtcattgccgccatgctcgctggcattaacagcgcccatcatataaagaacaggctgcatatcaataccgttctggatgtcagcaaagtcaatcgacttagaacggccggacttatagtcactgacctgaaagtagtccttgccatcgatattgcacgcatctacacggtcgataataccggtgtaaacgcctttcgtcttaccgcagtcaacggtgattgccgggaagtcagcgccttcgccgccgatacggcattcaaacccagtgctgataaagtcgctggtacgtttacggggtgcttcggtttccatgatataattgaggatttcccttgcctgccgcttgtagaggtagacgaagcgttccggcgcctgctcgataccgtgcatttccttgacggtataatcgtcgatatgtttgttggtgatggcaagcagctgctcatcagagatctttttgaacccgcctttggcttcaacttctcggatggtggtctccaggatcttatgcataaaatcgccgaagaaaggctcattgagtttggaacgaggaggctctttcaggaggagaccatacttcaagaagtaatggtatcggcacgaagagtagacattgcagcgtgtagccgtcagatttactcgctcgccaaacagaccacgaacagaatgatgagacaggtcttgcagttcccagtctgccttatccgtgacgcgaagggctgccgtctgcaaggccggattgtcgataagcgcaatacttgtgatgatgttatcatagcctttgcgattatatactcgacccatcaggcggcctgtcatctcggcggacagcaggtctgcttcgtagatgccgtttttgccgcaaccacgagttggggtcagctccgggaacatcatatttactcgggtgtacaaatgagatggggttgctggtgtcgccgggtcgctggcgtaggagaagacaagcattttctgcgcaccggcaacaactgtattgatctcggatagagatctctttgcaatgtcatcgcttgtgcccgggagataaatgtcagccgcagcagacagctcgttgatttctgcgtcaccgagtagaccggacggtgcaatatatgcagggaaaacgccctcctcggcacccgcgatatatcgaattttagattggaagtatcgagcgtcaccaagattaaggacattgatctgatcaacactaacagggatagttgcaatgcgatatgtgctcagcatcaggcggaacagttttgcaaactcagacggcgaacgctccatacttactgcgacttcgtgcatctgctccatcgcgtcgttgagtacgctggaaatttgagcgtattctgccgcaatctgatctttgctctgctgcatatcatcaacgatgctttgcaggcggtctacgaactggatttcctcaagaaattcataaaaagactcgacctgctcagcgacgtttttgctgtctttcaggctttgctgcagattaagcagcggtgttgcgcatttgacacggatacgatttagttcagcaagagtggctacatcagcctcggtaaaatcgtagccataaccgcgagggtgaagtgcccaaccatcggtatctgtaatccaacctttgccgtgaatgttccaggtccgaatatattcttcgagaaggtctacctctcttgcatcaagcccagacaacccagacttgatataattaagagtatcctctttctgcatgccacgagtagcgcaattaagcgcagaaaagatagctaacatgagcggtttctttgcgatttcgtccttacggctcgcaaaatataccgggatatcataacggcggcatacggacgcaaggatgggctcgtaacgctcataatccggcaggacaatggagatgtccttatagcgataaccattgcgtacagctcgcaggattgttcctgcgatgtgctgacattcttgatacgggctggggtcacaaaacagacggataacctttgctgcgtcgcttatagtgctgtctgccgcaggagtctcatcacagagatgttgctggagatagcttaatgcagcgtgatccgcgctattattgcccgagttgaagatgtcataatccaaacccttggctttggcaaaatcgatgattgactgggctgtgtgatttgcgctgatgcggccggactgttcgtcgccaataccgttgatgtcaaaagcaaaatggatataatccgcctgctggatgagcagctgaatgaggcgcatctgctggtgcggaaaatccgaaaagccgtcaacaaaccatgcggagcctcttgcccattgcgtagttgcgatgatatctgtgatattatcgatgtgctcagcagggtctagtgcgcttttctggcaaatggcttcgtattcggtgtacagagccgccatatcgttgagcttattctggagcacaggagagacctttttagctgtatcctttagttgctcaatatccataccggattgacgcagcatagagtaattgtcgaggagcttgcccagaaactcagggcgagaggataggccgctgtacaccttcagcgcatgggatttagtggcgttgtctgctgcgagagcaagggctagcagacgaccgccctcatcgagcatttcagcacgatgaccgcattcagcatgaactaagtcgaaaagctcatcgaagccgacaacagacacccgattattgctcaacgagttacccaaggcggcgcagacagagcgtgtgtataggaaggtgctctgctcggggaccaacagaaaaatgcgtcctgcgtaagagacagaaagatttttgatcgagttaaccagagttgcctcacgtttggaacggtttagtcctgtttgaatcgtcagcattgcactcaccagccttatctttgatggacttattatatcactgtttgaagttttgtgcaacccttattttaaagttcgcaggaatgagaaaggtcatcggactgcgtttgctcgatggccttgtgcgttggttattctgtttgaatacggcctcttgaacgagaaataccggagaaaatggctcaaagcaaaaggaaaaccccagtattgatactggggttttcggtgtggcaatgctgaattgcctcttgacttttgtaaccatataatagcacgaagccattgctttgtcaagttcttgcttcttgctgctccattccacgcaaatgacgtctcaaaaacaaaatgtccccggtgatggcctaccggggacagagggtgcttagtgagcatactcttgtcatgcattaacatgcgtagcacaagacaattgttttgtcaagtttccattatgtttgcccattcctattttactaccatcaagtattacacaacgctcaaaccagatgtggtgggagaataaatgtatttttgttttactaccattaaaaattacacaactctcaaacgagcgtatgggcacgttaccgttggcaagggttttactaccattaagaattacacaactctcaaacccacaccgcccaaggggagcaactctcgcagttttactaccattaagaattacacaactctcaaacagcgtgaaggtggccagattgcttacatcagttttactaccattaagaattacacaactctcaaacaggggtgcgtgacggttagccgggccaatcgttttactaccattaagaattacacaactctcaaaccagtgggaacgctatctgcgtgccaatgcagttttcctaagctagaagagggacgatatctcgtttcttcgcttaagcctccaatacatttaagattgggatgagtagaattgcactgaaaagcctgtaatattttgagcaaaagttcacattgttccttgatgggcatgcctttgaaaattgctcgaccattagataaatgggcatgtaaggccttcataaatgtcggatatatcgagtgatcactttttgctacaaaccaatcgtataacgaaagattttgttcttgtgttataccatcaaatttcgaaataggcagtgtttcatcttttgaggaggcacaacgcataatatatttagaaagtaattttacatattgctctcgcttttgatcaatgaacaactgattagtcagcttaagctcgagtaaatccctttttgcagcataccctgataaaagcagccttttattatccaattcgagcgtagcattaagttgaattttatcatatataatctttggatgatctagtttcaaaacttttttgcaatactggagtgcatttttttcatataattcttttcgataaagcaataccgggcggatttccctaactcgcttcttacctttggtaaactccacaacaaaacaatatgcaatattctgggtttcgtatccaccatacttttcgataggaagtgtttcctttttacgaatttgacctttgccagcagacttgtgggacatatcgaacagttttccgtttttttcataaggcatgtgcgtaacaataacactgttctttttcatatagcgttgaaccatctttattgtttcttttttgttccatgcatcaggagtatccatctttttgaaaagagtttcggcctttatactatatttttcattttggatatttttaaagaattgctctgtgaaacgcgtatcatacacgttgccaacgacgatattgagatatgcatctttggcatggtgcagatcattgacctctcggcatttaatcatgtcgaactcctgccggaattcagacacatttccggctttggagaagacaatgcgtgtgttatctccatatcgatctttgaggagagccgtgagggccttggtggattgctgcgtttgaacaagctgacgtgcgatgaaatccgatagctcctcggttgtaagtggggtcgagcggaccagtcggctatacttcttctcactgatcaatcccttgtctttgagcagtttccagaacggaatcatcctttggcgaatattatcgtcaatcggatacgtgtttttcttttcacggttcaattcatttttgacgagtaccaaattgcttaggctgtcatccttgatccttgagcgcgggaaaatgtgatctcggtcatatcgctcgccgcgcataaccgaagccagatccataggctcaccagaatacatacacctgccaaactgagtatagtacagatacagacgttcgctgcgcaagtggctttcctcttcggactccaagtgcttggtcaaatccttcatttcggcatcgctgatgcacatctgagccaagagctgagaatcctttttacatgccttatacaactctaacagcttgtcttttcttgactctgtgcgcttccctttcagtttttggctgctatctcgcgctacctcgacaaaaatcttggccggcgcagctttgcggagctttacaatttcatcgacaatgcgaagcgtctgtcgtatgcttctgcgtacagccggagagatatagagctcgtccaatttgtcggagagagtctcattattaccaaaattctcattccggtatgcttcggcatgtgccgcaaactcatacttatcagacagtaactgcatgaggttgttgttcgtgcctctcagcatgtccatgatattcttggcttcgccgtattcgcctgctgtgtaaatgcccgtgagaaatgttttggaaagccgtccccaatcagtatagtgcaaacgagagattttcttaatatcgccttcggtcaagacatctgcatgcgtgcgcagccagcggcgcagcattttcttatcatcgccaaagacaagaatgtgtcggatgatatcttctaccagttcacggtcgccggttcgtgtgagaatgtcggcgaaatccttgtgtgaacgcaaatccgatttaatgtggtcgtcaataccggtaattgcatctgcatcaacctttttagacagccatccgtttgcctgcatgtacgcaaggatcttgcgtttggtgactttccccttctggccgggtgcagggtgaagaaacatgtcgttaatcagctgcttcttctggcctatgggcagaggctcgccttcaactttaagcggattcagctcgttcaatagggtgaattcgctgtaaagcagagaatctttaggcagaaccaaatcaccggtataggtacagcggcctaccagattgaccaggaaggcttcagaagagcggttaagatcgatgagacgatcaaaattccatggatagatgcgctgtttcttgccttcatcggtgcgaacagcccagtgatgagaggcattgtcgctaagcggcccaacgtagtaaggtacgcggaatgcaaatgttttcttaatcttttcggccggggtaaagccgtcgttctccttctgggagagaaacggtaaataagacgatgcattagtgagaattgcatctacttctcgcatttgcagctgataagggataacgccattttcgtagtttctgaggcgggggagaaaacttccgtcgcagatttgctggtaaatggtcgagagggctggatctgcttcattcttcagctccggcaagacttttttcaggaattcgcagaaggcagcctgggagcaagcataatctccacttgcatgatgataccggctatacgcagcataattgttcagcttatcttcctttgcacaaaagatttttttgtagtgcgccggataatgttgctggacatagcgcttgagtgtcttaagatcaatgtgattttggtcataggcagcaatcttagcgtcgcaaaggaactggtgtgaaccaatgatttcggccagacgtgctgcatcgtaaacttccttggccgatacgatgacagagatattctcttcaagggtctcgctcaattcatcgtaatgtgcatccagatcgtcctgcatggacacgcttacgtctttaagttgtgcatcgccaaacaggtttttcagcttaacctttttgccggccagcagctccgaaatataaaactgagacagcccttcttcgttctttcccggtttcttcaggccggcattgagggcttgtgctttggcggtaagccccatatgacgagccttcagtacattcagatattcgtccttgtctgacagcacgatatcgagatcatatgtgtcagataggaatgcacagaactcatcgaatttactctccaaggatgagccgttcgacgatgtatcagacatttcgtaaagaaagtgaccgcgcgatttcatcaggtgatgcaatgccagaaaaacaagtcgaacatcgtgcggttcggtcgaatgagccagttcgctgcgaagatgataagcggtcgggtacgccttgtgatagtcacggtcggtaaaattctcatccgcaaacagcgaatactttgaggagccgcttttatcttcctgccagagatcactttcgtgcatacgcaccaaaaactgaggatccttttcgtttaatgccggagcgaacagcatttccaggatatccaggcgctgcttgcgtcgggccaaacggcgccgcgcagaacgagcagtacgtcgttccacagctgttttagcttccgggaaaagtcggacaccccacatatctttacctttgcatcttaacagacgatacaaagggtcagtaacagcccatccggcggaactaacacctacatccagacctatatagtaatcactgtatggaatgccacttaactttcttgcaggcatttttctcactccctattgacaaaaatagatttaaggcgcataattaagttgttcttaattttactaccattaagaatttcacaacagttcaaataagcattttgcgaacccgccgttttcacggcccacagtgtgtggatgaaagagatctcttttgagatctctttttatttttaataaaaaggattgcaaaaaaggaaattgaattattgaatatgctttaattatatcactaacggatttatattgcaatgcttattgttcaatgcaaagtgataaataaatctattgtttggacgagagatgcgaaaaggtcttcaagaacagctgctgcgttggggagcaaaaaaggacctatcaacagtgatgatactgctgataggtccttttattatgtgggtggaatggactactcatcttcgcccgagtattcccttttcgatttattccgggatgagatcttcttttgacttgcacgcagagtgcatgctgctttgctgcgatgtgggagtaactcagttatccgcgttctcataactgggtaattttctcgaagaatcctctcttcttcttcggtccaaggaagcatgtgcggcttggccaatccaatttttctggcgtgggcctggcatgcacggtatgtgcgataagggaaacgcgtaaagcacgcttctccttcaatcgggtaatatttgcgtagtatttcgttgtcttctttggtccaacgagcatactctttttttgctcctgtagaacgaattttcagttcactggccttggaagtgcagttcgtagcagtgcgattcggcaggcgtttgacaacgcgtgcgccttcttccggataatacttcttcagaatctcaatctcttccggggtccagctgttgctccgcatgtaccgtacttctttattagatgaaataccaagaaatctcgctcgcagtctacatgcctgacgtgtacgaccatgcaatctcttatttatagaagaaccttccgaagggtaatactttcggcagatttcatcttcttcttccgtccattggcgccgttgctttggattctctacataattcgattcagacataaacaaaagcaccttctttcgtgagtttcaaaactcgtaattttgtttgggcttgaatcatttattttgattattatatcactctttgattattttgtccagatataaacaagccgggcgttgtaatggcgaaatgacacgggattccaaacccagttagcgggctactgggtttggaagtcgaaaagataatagtagcagagcttttgccatttatcccactcagtttgaagattctcaggaagatggtcgatatcatagatagtgccgttttctcgggaaacaacacctgcctcgtgagcaaccgatattttcggatagatacgagacataatcagattgggcagtgcaggcagatcgaagccggcctgctgtgcaaccattgctccaagaatgcttgggctgacaacgatgtcttcttcagaagggctatcatagtttgtccagataatgaaaggagttgcagaaccgatcagtcgctgctcttgcgtcgttttatccggataatacgttttaacgagttcagaggcaaatgaaggctgatggtcgccgaagaatacaatcattgtaggctcatctatgcttttgtaatgctcaatcaattcgcgtagcgcttcatcgctgtactgtataagagaaagatatgtttggatatcatcggcttgtgagctgttctgtaattttgatggtagaggggctgtattctcaaattcaagaccaccttttgtattgattctggagtagtaaggtatatggttttgaattgtgacattgaagatgaagtttttctcctttttgttaccgtccgttagctcaaagaggtcttcaaaatcgcatttgtcgctgtacaggcccaaaagcattcgatccttagacgtatacttgtccggatcggtctctttgaatatcatgttatcaaatcctatgagcggataaacgagcggtctactccacccctcttggttgtatggatgaaatgcagtggttgtgtatcctgcttcttttgcaagagagaccatagagggcattttgtgatccagataaagttgatatgctacagtctcatacggtaaaaaggcttgactttgccaggtgaggaactcatattcaggcaacgcagtgcctcctccaaatgccggggatatcgtccatccttttcgagtattctctttgaggctgtggagaaacggcgtataatcatatcccatttgagttggccgttcataaacatcaaaatccatgaacgcttcactcataatgcagatgatattctgcggctgggttatatcttccgcctgcttggtaccgatttcttcgatgaggtcttccgcttcctcggtggaatacccttccggagcggataccttctgtttcatacctattagaatgaaattcatgagaaaaccgttatcttgagtaaaccactgctgtggaaacagatcgagccatgtgcgaaccggctcataacctattgcgccagtcgccacaatggatgagataagggcacccgtcaggtacgctttccaatgtttacggggcgtttctctcttctggacaaataccactactaatagaatataacagaataagagaaaaattccgtgaaaaacgtagtcatctatgctcaagctgagtttgtcaccgatggcccacacggtttgccaacttgtaaaatctgatggtaccagaattcgattgcggtatatcaggacatagtggtttatcagacccacaaagccccataacacagggtatgagatggctacaaattttcgttctccgaataccaatgttaatacgccgaaaattgcggcatacatcagtaggttcagtatcagtgagactgcaccgaaggagctggtattgttccctactccatttagagcctcaacaacagaaaaggccataaacgggctgcatatatacaggattttactgacaatctgtctgcccttctcagttttaaaccagttttcgagctgtttgtaggctgttttgagtttgttaagatgctgcatatttgttaccccatgacgttaatggcaatatcgggcgtcaaataggcactgtatttttgcccgtttgcactgatcgccatcattccctggggcgtcgcgatttcttcatcaaacaccagcccccagcagctctcatcatttggcaattccagatacaccggatgtccgaacagcacatagagttcttcattggaaagttccaaatgttccatggccacatgccgagctgcaaggttggagatagccagattatatttcgtcaatcgcttcgaaaggaacgacagcatgatatcttgcataaagccggcactcgtatcacggtactgggacgcttcagcagcgttgcggcggctgaggagcgtgatcatgcgagtatcattggttatgctgaagggctcgaaagacgtatgatatccgagcagccagatgacagaacagttgaaagcgtgagaaatggatatcaactgcgttgctgtcggctcgatttcgtcatgttttagtagaatatctatttctcttacagataatttcgtttcacgcgagaaccaatcgacagagtttccatccatcaaggtgtgaagtcgatcactcggcagaacgatagggcttataaagccatctgcaagcaaatcattttggtaggaatgatgcgatttcaattcatcatttgtaatatctccggaaggggatttttttcttcggagaaagtctgtggtaaaacccatgaacaaccttctttcaaattttacgggatgcgatgatcgcaatccacatgactatatacgctggtgctatataggagcaaagagggatgctctcccccttttgatgccttttttgcttcagcttatctacgataaaatgcaggacgactgtaagagccagaacaatagctactccaatcaggcctaagaggaaagacagcgaaagatatagctttaaatcgccgccaccggatttgtagtgacacagcttatttaaaattagcagtattactatcatgcacacaagattcagtatctgcgatagaaatgtattcggagaaaggcatccgcataggaggattatcagtggaatcgaattagggattgtccgagatttatagtcggtatatgctccgaaacaaagagcaattcctgagattatgtagcctataataggaagcacgaatttaatttctggcatttgatatatatcctttccggagcaagtatgcaacaaatagtattcattgtatattggaattatagcattgttggagccaaacgtaaagcctttacaattagacgaaaaacaggaccggattttcggtcctgttagatatgcaaaagggactgaccatatctcgtggtcagccccttctattcgtggattactattgttgcgaacgatacaggaaagaaacgatttgagcacgggtgcatctcccgctcggattatatcgtgcttccccgacaccgcttgtgataccgttcttctctgcccaagctactgcatctgcatagtagtcattgatatggatgtccgtaaagccgggctttgcattaaccgacggcgagccagctgcgcgatacaggaacgctgccgtctgcccacgcgtaaccgtggcattgggtttaaaagcaccattaccagtaccgttggtaattccctgctctactgcccacagaacagcttcgtaatagtatgcgttccgatcgatgtctgcaaactgaacatctccggtgttattcggcttgggacagcctgcagctctccaaaggaaggtaaccatctgggcacgagtgcaggacaagttcggactgaaggcgtttgcgccggttccttcggtaatccccttctctacggcccactgtacagctgctgcataataagcagtagaaggaacatccgcgaagctgatattatgcttctcttggatttgcctgaacgaaacggtaatgattaccttgccatccggcatgctgaagctgtacttgcgctctcccttatccgtcaatgtcaaacggttaccattctgatccactgcagacagattgcttacctcatagccagtatccggctttacagtaatcgtcacggtacttcccttcgcggccgtagttggaacagttaccgcaccgtttgcagttttctgtacacttactgcatagctcggaacggacgaagaactgccgccgccggaactgctgccagagttgttggaagcaagtttcgtaaccgtaatcactgccatattgctggtcgttcttgcagtcttgctgccatcaaccgtatcattagtgttggtcgccacaacgaagtagtaataagtgcccccttcatccgtagacggagtatacgttacgttcgttgcattttcgattgccgtaccggtgaagtccgtctcagacgaagcgcgataccactgatagctgatggtgccgccatcactaacagtcgttgtaccattcagggaaacagcagtatctcctacgttgtactgggcgctactgagtttgatagcatctggagtgacggcatcaaccggcgccgcatctgctgtaaaggaccagtgacccgtaaactttaccgtcgtaccatcaacagaagaagtccaaccgctgaaggaccagtgaccgcttgcgccattcttatctgccgaggaggtagactcgctggtatatgtctgtttatccagtgcagcttctgcgtctgcgatgttatcatactgtgcctcatccaccgggagagctgcatcatccgggaactcactgccccaatcatagaggacagaatagcttacagacacctctggctccattactgcaataacggccatggtgcttgtgacgcttgtagtctggctgcctgttgccgctgtgttggtattggtcgctactacatagtaataataggtgccggctttatccgtgggcggctgatatgtcgcatttacagcaccatcaatagccactccgttaaagtcgtctgcattggtgccttcgtaccactggtaagaaattgttccttcatcggatgcggtcgtctcaccattcagtgctgcggccgtatcgccctgcttatacgaagcattcatcaaactgattgctgctggtgtagccgcgtccaccttttgagtttcaaagaaggtccagtgaccagtaaactttacgatcgtaccttcaacggatgcggtccaaccactgaaagtccattttccctgcttgccgtctttatccgcagctgaggtggaagcgttggtatatgtctgcttgctcagcgcagcttctgcgtctgtaagattgtcatagctttcatcatccttcggcaattctacatccgatggataatcgttgccccagtcgtatacgacagaatagatctccttaacaaccggtaccatgaccgtaatcgttgccattgagcttgtgacgctggccgtcttatttccggttgcatctccattggtattcgtagcctttacgaaataatagtacgttccggccgtgttggtatcaggagtataagtgggttccgtagcaccatcaatgacggttccttcaaaatcatccgctgtggaagcctggtaccactgataggtgattgttccaccatcggcggcctgcgttgttccgtcgagagcagcggcctgctgccctatttcatagtttgcactgatgagtgtaatatccgccggggcttgcgcatcggtcggggcactgaaaggataatatccttcgtagtccgcttcaaactgagccagctcatctgctgtgaggaggtctacccccttttcgaccgctgccttctcaacagtgaatttcgtgctgtcccagaagtctgcctgttccggatgttcttccttcaacttatccatataggcatgcatcacagtcgcatactgcgatgtaaggtcgcccgcgccgacactgccatccgaggtaatctgctgcaagccgcgtgccgtaacaacatattcagccgactggctgggacgcatggaaacagtaggtgcggtattggaataaacggccgtactgcctcttccaggctcagctacatagattttaaccttgtaccccaggcccaattcgaccgtatctgtcggcgcgtagttactcttattaccgatgtactctttattgtagcaccggcttccctttgtatcgtaaacttcaatggaggcatacgcagtcgagaagttatcatgcggatgacaattacggtgttctaccgtcagtttgccgtcctccaaatcaaatcgcataatactgaacagaccggagtaccaactacatagctgatacgtccaatcagaaaattgagttgctccaatatccttcggcgtatcaggttcggtgatctcgaatgtgctcgtaccacttgaaccctcatagttgccgataccggttgcaataaccgtcgcagtacctacatcggtgttgtttacataagagaccgtatagtctttattttcggtcaacttcatcttgccggacataaccgtgataccggtcgtaacaggctcaccggtatagctgatgttggtcgggctggtggtgacagtcagctcaacggatttgggggtaatctcgaaggtcgtgctgccggaaatgcctttatagttaccgataccgtttgcggtgatggttgctgtgccgacattggtgttgttggaatacgcaagaatataatcgacgttacgcgtcagcactttattatcaatcttgaccgttgcatccggacgtttggcaccattggagaacgctacttcactgtattcgctcgtaacatcgaaagatttgggcaggctgtccggcagcttgatctcgaaagtagtttcgccgctgcaatcgctgtactcacccaggccatatacacgaacccgtgcggtgccaacatctgtgttgtgcagccattcggcatggtagtcatcttcgctcagtttggtattccctactgtaatgtcaagatgcggagttacagcagaaccagtgtagtcctgtgccgggatatcggcaatcttcatctcgcggataccctgatcaaagggataatagccttcatatgccgtttcaaacgcctttttgtactcctctggcagttttgcgaccgcagcatttacttttgccttttcggtcgggaatttctcggcattttggaagtctgcctgcggattggaggacttcagattatccatgtaggcggtcagaaccgaatagtagttatcttcatcgaatttctcgaccggtgacagcatttttagaccgtattcagttacctcaaacttgaaggttttctgatttggattattattcttcgaatcattatagaccaatgacacagaattcactgccgaagactgcacataatagccgcgtcccggttcttggtgaaaggtttcgattgtatagcccggctcgatgtggatggtggtatcctcttttggggtgcccttgccgctcatctgcttgttgtagacttccacgccgtcggcatcgcatactttgagagacgcgaaattatcaatataggtatgcggctggcactgcaccgatgtgatatgcaaggtttggtttgccatatccgttgtagcggtgcagaatataccattataggtgtacgtcgaaccaaaacggaatgtccagtccgcaaactcactggcagcggtcactgcctctgccgtaacggtatagtcagcattctgcccctcgccgactactgcataacccacacggttgttcagaacaatattttgtccatcctttgctgtgggcacgatgatgttataatagccaatcggcagatcaatcgtcatatcctgtgcggtgatttctacttctttgaccgtattcacaccatccgtaatacggagcttctgcccttctgttactgcaaaggaggtgtcatccagatgtactgccaatgtaccagtgattgtatcagcagacttgaagtaattcagtagttcctgcgtttccaccagagagtatttacttgtcaaatgcattgcttggcgaatggtttctgctgttgcatcgtcgctgacaaggtttctcagtggatatacattttgatatgtttcggcttcgatgagcgcctgttttacgttgtctgaaacggtgaaaccccacatatcaaaccaagccgatacgttgtagccgctgccgcgtgtataagcatctacatagaaatcatggccgcccagattggcgataccattcgccttattgctgcggtaaagctggtaggcatacgcagaggttttctgaggacctaacttatccagcatattgacccagaaatacagcttgctgccgtaattattggttttgaagtaaccgttttcagcacgttccttctcgtgccctgctcgggctgcttccgaggagttcagccagcggccggcaccgaacgcagaaacctggtaatagtgcgccatgacattgttccagatctccgctgaattgaagtttacggtatcataaccatgaccgacctcatggagaggtccccagtttccggtattcatataaccaataagcgagtcgccattcggcgctgtttccactacactgtagtatgctgcgccggcaccatgtcggttgaccttgatgaaatatcgtgtgccgctgtcctggttccagacctcagtcgcgtttttactcaaaccaacgaaagaattgtactgccggatcatgttatcataccacagcagcaggtcatccaaagaaccaacttggttgttcgtcttgtctcttgcaggcacgagccagatagtatactcggataggaacactgcaaacggcgcgttcagctcatcccattccttgtagaacgcagcctcatctccgccaaattcatatacaggcagtttctcagtgccctcaacggtgaattccacttccggcttctcaccgttcgcactgtatacactggaaatcaggggcacactgtctgctatagctgtaatctcaagccatgatccatccttattcagcgtatatctctgctcggtttggctgtcatcattgcgcattttcagggtcaaattctgaccaagcgcggtatttgtctgacgaattttgaatgttgtgccctttggaacccaaataccaagatgctgacagtcatgcccgttacccttcgtggtaccggcgccattttcatagcttgtgtttccgacagtgtacaactgctgggttttcgtctgcgattgctgtgcctccagtgtgacggctgtgttgctcatgtctgccgggagcgcataggctaccgtacttgccgggccggctgccagcgttacggccatagcagctgcggtcatccgaacggctgtgttattttttttgcggtgttttttcatttctttttcctctctggggtgctcgctcgagcttccaccactggaagcgtattcttgcatgtacaattctaacacagtattttcgacaatcctacatatttctttgcttatgccaaaagaaaagcaggacaccagatggtgccctgcttgggtgtagctgtggatgagttatcctttcccatatatctttcggagtatgccatgaacatcatctaccgaataagccggatcaccccttaactgtgagaactcggcgttcaaaatgtcggaacgatgcctaagaattttgtcgcagttttcgatgtccaagttggatgttggatttccgcctttggcgtcacagagagtatgctccatgagtatatttaagcacatttaatcactgttgaaatgttttcggtttcttaaggtcgcctcctgagaatatctcagaagcttctacttctataatatataactcgaaatggagaaaaaacagaaacagcgcagccgaagctgcgctgtttgcctgtatgaggtttacttgctcatctcgcagaaccgcataagaattgctgcaacttcagcacgggttgcgttattctgcgggtttagtttgccgttcgagccgttaacaatgccgttggcgaccgcccactgcatagcatttacagcatagctgcttacgcttgcagcatcggagaagctgtcgagcgaaccgttagccttcggggaaccggcgtagcgatacagcatggtaacaagctgctcacgggtgatgtttacttccgggttggtgccgtcggatacgccgttggccttcgcccagttcatgcccttctcgtactaggtcacgccgccggtggtgtcctcgcctgcgtagcgagcgagaacggtcatcagcataccacgggtggtggatgcattcggtgagaacgtatcgctgccggtgccgttcatcaggcccttttcggtaacgtatgcaaccgcatccgcaaaccagtccgacttttccacatcaacaaatgtttttccggtcggctgctgtgcgatttttacgaaaatcggcgtaaccgttaccttgcttgcgggcatggtaaatgtatatttgccattgcccttatcggtgacgctgatggcgccgcccttggcatcggcaacggtcagcttgtcaagctgatagccgtcatcgggcttgaccgtaaccgtgaccgtgctgccattggtggcgttcttcgggctgacgatgataaaaccgttctcggttgtgcccggcgcggtgacggaatagctgggcttgctgctgccgccgctcgacgacgaaccagaggacgacggacgagacaccaatccggcaatcgcgtcttcaatggcttttgccattgcatcgacttgggactgttcggtgatgtttttattacgaacaacatcagcaatggccttttccacagcggaaaaatcctgatagctgttcttgttcagtgtatttgccttggcaatggctgcgtctactttggtgtaatcggcatccttgtattgcaagtcagcgatcgcatgctcaatagcttccgccattgcgtcaactgcgggttgctctgcgattttcttatctcggacaacgacatccactgcggctttcacagcagagaaatccttgtagttatccttattcagggcatttaccttgtctatggctgcatccacttcggtatagtcagcagggtcagtagcaaataccggatagagcttgccttgcgcgaaatcattgccaagcaacttggcaactgtgccattagtgaattcttcggaagtcttttcagtagcactacccacattagtagtcacagtgcattcgccataataacagttcgttgtattgatgctggctgtgtaggtgctgccattcgtaaaggaatatgctgcaaacacaccagttgctgcgttgcttgcagaagttccttcagtagataacgtttgtttgtaggcataacaattagtcagtgcaatgtcagatacaatcataccgataaagccgcctgcgaaactggtgccacttgtctctttagtttttacagcaacagaacaatttaccgcatagcaatctgtatatgtggagtttccaacaccattgtcatcatcattttcgccgacgaaaccgccgccgtaagccatggactgaatattattagaaactgacgcacagttcttaaatgttgcgcctgtagaataccccgcaatacctccggcacagttgttattgtattctcgcttgctttctaacgcagagttttttacggtgcaattttcgatagatgcagcatatgcaaccgctgcaataccacccacatagctgtaatttccctgaccggttgccacaaagtttgcgttttctacatgcaaattttcaaccgtcccaaaagccacccagccgaaaatgccggctgttgcacatccataggaatctgcatcatctttatcacgttcatcaaccttgccggtgcttttgactccggtaatggtgtgtccgtcaccgtcataatgccctgcaaaatagcacccgtctgaatatccgatagggtcccagttcgcaatgccattcaaatccaaatcggttgtctgtctgaagtagtaaccgtggtaattcccgggaatcccgttcccggtatccgtgcaatcctcatcaaatccagcagcttttccgtcattgattgtgtttgccagcagttgtaaatcttccacggacgaaatcagccacgggtcgtcttgcgtaccagaaccgccactatatgcaggcattttgcttccttcatcgtccgccgcaaatgccgcagccggcagcatagcaaagcacattgccagcaccagtagtaaacttgttatccgttttttcataaattttcctccttaccctacgcccgccggatgcagtttttgttttcgtttggagcttgtatattatcagtatagcacattcgtccgaagctgtaaattgtactaaagcatagaacattgtgtagttatttgtaaaagtaaatccctgttgggtgtggaatttaaccttacaaataaaacattatataataaaagaggtgccacttatcaaaatggcacctcttgatgttggacaatattatataatatcgttattgggttcttatacactcagattgaatacaggcttaattttatctgtaggcaatcccattcgcctagcataatccttttcatactcaaatcgagtaatactttcaataaagagtttttctttcggagttgctgcactccagcgaacattgaaccttttacacatctcaaaaaagatgccgtcaaaaatatctgcttcaccgctgcatcgatcaaaataccatttcgcgtctgaacgaacgggttcgcctttataattgatagctgccattataaattctccttcccagaatcggtcagataatcagagataattgacaaataagctttctctgagtggtctgagttgcattccggtcacaccaatgcacccaagaccgtattacgcaagctcgtgtcttccatttctatagccttgataagcgaatttccgtcgctcaaaattatcacttgctcacggctacgagtcactgcagtataaaaaagatttcgacgcaggaagaaactcatcgaactgaagagtggaatgattacctttgggaattcgctgccttggcttttatgaatcgtaatcgcataagccatctccagattaaaagtatcgtccttcgtatatttcacggccggttcatcatcatagaactgaacagccaatacatactcatcgtcatcatccatttctgttttagaatctatatcagagtgattatacactttcgacacaaatccaatatctccattggcggcgccttctatatttcgggtttgcatgaccttatcccctactcgaaaacgcttattaccaatttcgatttctgccttatccgaaccgggcgggttaagaatgtccctcacagcctcattgatgctgttggtagaagcggcgcctctctttttcatcgggcagagaatttgtacatcgttcgagatcccgatatcgacgctccgtttcacaagagcttttataaaagccaatgcctgtgcctcgttttcgagttgcttcaggaaaaagtcttttttagaatacgtcagagaaggtatgccctgtctgatgttagctgcattgtacggaataagactatcttctttctgtctgaagatacgagtaaggcgcgtgcttgggattgatgggcacgacaacatttgccgtaaaacattacccggcccaaccgacggcaactgatcggcatcaccaagaaatagaacctgagttctgggagagatgcgatacatgagattagccatcagctctgcatctatcatggacgactcatcaacaacgaggagatctgcatcgagtttgtcttctgcagcgcagggttcgtcaaaatccgtgtgttcatcaggacgaagctcaaggagatggtgcagcgtagacgcctccatcccgatttgctcgctcattcgacgtgcagcacgacccgttggggccgcaagagcaatttctgcgtccggatattctttgatgaacgactctacaagcacatgtaagcttgaagtcttaccagtaccgggaccacccgtaataactgatacaggcgaagaaagtgccataacagccgcttccctttgtgtatcatcgagtttgaatcccagggagtcttcggtttctttgacaatatcctcccactcttccttgttctttcttggcttgccgtttttgagcatagaccgaagagccagagcagccgtacattcccatgtgtaggctgctggcatatagatcctctgataagctgtgtccggcttgtcaccctcaacagaaatagtcttcagagtttcttccttaagcatggtatcgattactgtatccacttgctcaggtattatttctgcatcgatgttggggcagttcagcacatcttttgaacaagccattttgcagagtgtttctctcggaagaaagagatgccccgcattttgcgctttatccagagtaaagacaattccgccggcaatacggaacttgctgttcgcaaaggcacccagcgatcttgcaagctcatctgcttttgtaaaactgaaaccacgcactttgcataactcatacggattattccgtacaatagcagcggcgcctttgcctaattttttggaaatgttttttatggcctgtgaagtaagaccgagcgggactaaaagccttgccaaagcgtgataatcctgattagtgatgtaagacgataagattttttgaagttttttgtgtttgattccggtgatagtcagcagtcgctgcggttcgtcctcaaggacatgaatgcagtcgcttccaaactggtcgtagatcagctctgctgtcttttcgccgatgcccttgatgagtccagaactcagataagaaacaactgcctctcttccctcgccgatatgatcccggcagtcggatacgtgcagctgcagctgtcccgtgaacttcttattaggctcccatgtgcctgatagaaggacttttgcgccaacctttgttcttataccctcgccaagagccacaaatacagcttcgcctctggtggatgcagccagaaagtctatgcaggcatcttgtggaataccgcgatatgcagtttccatttcgcaaatggagaaaagatctcgttcaaaccgtatttttcgtaccttgcacggaatatcgattgcttgattgggcatagaatcacttccttcattagtgtaatgatatcactatgcagtttgtcatgcaatataattatgtttacgacaaaagaaaagcaggataccaaatggtaccctgcttttacggttactggtgtttgttgatcgcttcggcgagctctataatccaacgaggggcctcgttatagggaacgattttgccatttagatattcgccaacgacaataaaaccattgttattgtcgtagaacagggcttcttggcaatacggcaggacggtcgctaaggctttcactcgaccttcaaaacgacgacgtacatctgcctccggaatgtcgtgcccgcctttccgtacccgatttgcaattcgtgcaatagattcttccgcagaatccaaccccacataatgcatgcaaatcttgtacccggcatcaagtgctttctgcgccgtatgtgcggtaagcgaacctgaaagagtggtttcttgcgtgaagcagagacctttagccaagcaatcgcggatttgctggatagccagacgtccagcgaggatattattgccgccgttatcggatgcgagtttatccgcatctataatttggcctaaatcactacgctgtttccaaaggacgcctgtcaaacttgatttaccggttccgtttacaccggcaataatcgtgtaagttttaatcatttgcgtttactccctttttgtacacctatatgtacttgataatagtatattagaaaatgtcttctttatcaagagactgacggagagattatttgtttttcgccgttaagtcagtatttaacgcatagccgatgcaagagctttcgcacttaacgatgtgctctggatcaggacagtaatcgcctttatcgcacagttcctgaattgtagctgtcgcttcaagatggttgcttgcccatacaacagcatcatcggatgttgttgtttgtactgtcacgagatacggacgttctccgttttcagaaatatgtttttgcagctcagagcagcgagcgacgaaagcatctgcggatacagcagagccatgctgaggagaaggaagcatctccattttcagcaactgacaccatttgttttgcggccgagtttttgggagcgggatctctactgcacaagaaaaacttgccgatttataattcaccgggctcaccgctgggaggccaagctgctcagggataaaatatttcccttcttccaaagaattacggataatctcctgttcctcatgagacagtgctctgtcgagtaaaaaatagaactcacgctggattggcggtaaagtgtcgagagttggagtcaaaaaggttaccaacgtcttgactggagccagttccagcgcatgatccagagcctgctgcaaactctcgtattctcgaggcgtagccggatccactgcaaagttattaaagatttgcagcaacgccgactcgatattgcggaagcgccacgtcatctgaccatccgttctaaacgagtgatgcaatgtgagctcaaatctgaacggcgcattatcctcgtggagagcaagagagatatggccatagcttcggaacgaaaactccttggttgtgccatcaggccaagtgttggcttcatcgagccattcgagaacatgattacgatataaacgtggataattcatatataatatctccttttaatgagtggttttggggttaatcttttgggttcgagaggacttctttgctcgtaatgtcggcagcagttgcaaagcctacgctcttcccgtatacagcagaactatccggtgtgcccatgctgatttccttatcagataccatctgcttggcacgctccgcagcttcgtcatgggttttggccataactacgacagtgcgagttcgtacctcggaagcagtgcataaatagggcgttttatcaccgtctgccgatacacaggacttccaaccgttacgcagttcctggaaacgcgcgacaagctcttctgtggacatgtctacagtagcttgcctggtggtcagtgaacaagccgtactccattcgcaccagcgcggaaacggttcggaagcagggcgatcatagaaattgagctgctcagggacaaaatattttccctgctcaagacaatcctcgattaccttcttttgctccggagtcagaatgccttttataaccacactatgctgaacagcgtgatgatcgtcgtcgcgctcaaaatagaagatgagcgtgttttggccttctgcttcgcggtcgataggggtagcacgaaaatccgcaatgaaaccgcttcttacagcaagcaatgcgtctgtaatggacttgtagcgatggaccatcatggaatctgtgtaatcgctatatcctgccacctcaaactggtggggcgcgtttttcttgcccagtcgcctgatctgaagagtccacggaccgcatgtgaattcctgtacggtatcgagtctccatcgatttgcctgagtggtccactgcttgatgagctcgggggtgagtttctgaatcatatagaacttctcctttgtagtagattattgtaaatggaggggctaaacgccccttcatccataaaagttaattgttcgatgcatcatcatccgacaaatccattgtctttttgacgtcttttagaatattgtgcagcacagaagcttcgtacatatccagaataccgcttagagaaaattgaatgtatggggcctctttttcagaaccactggaataaagccaagagttaagttgcaacgcagaaaaaatgttttcgtacaaaaccgactgccgcatatataactcgatttctggattcgaaagatctgtatcttcgtccaaataatctttgcatatatcgaacagtttactctgtggcatatttgtaatggtctcaacacgttccttaaagaacgggatgctgccctccaaccactcctgaaaatcataattctgatctgtggaattttgaaagtagatgctcatcgggaatgcgggatcatcgatgcgattggatccgacaagacctaatagctgatatttcggccaatacagaaagcggaatttgaaaagattttcgagccagtacctatctgcaacatctgccatgttgtttgctttttctatgtggctgtatcggatagaagggatgtatatcgtgttgtcttcgatgaacttccttgcatttttcttctccatgcacttctcaacgtagtgccgagcgagaacaaatgcttctttctcatcggcagccatagcaaatgacatatcaaatgcgtaactcatacttgatctcctttttatagtgtattgccccactctctaactttgagagtggggcaattattattagttctccgctgcatcagcatcggacataaacgaaataccgtccgcgatgagcttgccatcctccaccttgccgaagacaataactacagcaccttccgtcaactgatctccatgtgcttcgaacgccttgggaaatacagtaacatctgtgttgctcgtcttatcttcgatggtgacgaaagccatgcggctctttttgcgagtggtaatcttgcgtaccgctgtaacaacaccagcaacgcggatttgattaccgtcatctgtttcggaaatctttgcgataggcgtatcggccttcaacttgatttcttcagcaaatgaatccagcggatgaccggagataaacataccggttgccgcctgctccatcttcagtttctccaacatggtcattggagtaacatcagtaggatattcaactcttgggaagtggaatgctgggtcatcactcataccggcaaagaacgaagagtccagagccatctggtctttggccattttcttgcgggctttagcagctgctttggtgatggccggcaaaatcgcaagcatttcttctctgctatgcgggaaactgtcaaacgaaccagaattgataagagcctccagtgtgttggacttgacagaattgatgttgcgctcgacaagatcttgcaggtcaatatatggtccatggatcttacgttcctcaacaatctccgacaagatcgttatgcctgtattcttaatggccaggagaccatatcgaatgctatccccttctaccgagaacgatacctcgctggtattgatatccggcggaaggaccttaatgcccatgttggtaacgtcattgatataacctaccattttttcggtcttgtcatcaatgctattagtcagcagtgcactaaagaactcgtggggataatagcagcgcataaatgcggtgcgatacgccataacagcgtaacaggcagcgtgtgcacggttaaatgcatacgaagcaaaatcagccatttctgcccagatctgctctccaatttcagcaggaatgcctcgacgtacgcagccttcgacatccaccgaaccgtctgcattcagcgagccgttaatgaagacatctttctcgtgctccattacgtcgtgcttcttcttggacattgcgcggcgaaccagatcagctctaccgaacgaatatccagcgacttcacgtacaatggccatgacctgctcctgataaacaatagttccgtatgtgtctttcagaataggctccaactgaggaatcagatactggatctggtccttgttgttcttattctcaatgaactttggaatgctgtccatcgggcccggtcggtacaacgcgataaccgcagcgaggtcttcgatgcaggtcggctgcagtttcttcagggtgtctcgcatgccggccgactcaagctggaacacaccagctgtctgtcctttggaaagcatggcataaacatcctgagaagacagtttgagtttggtgagatccagaggggtcgtcagttctgtgtgaagttcattcgtcagtttctgagcatgatccagaacttcgagtgtcttcaaacccagcaggtctaccttcagcatgccgacagcttcaagacttgccatatcaaactgagagatgacatgtccattgcgatccttctgcaccgggataagattggtaaccggttcaggagagataacaataccagcggcatgggtggtagtgtgtcgaaccagaccttcaacgctcatgctgatatccagcaggcgcttcgcttccggatcatcctcatacatctttttgagagtatggtcatgatccaaaaggtcgcgaagggtaatgcccgggcctgccgggatgcgcttgctgatgttgttgatcagagtaggtgcagcacagattgctttgcccacatctcgaacggcgcccttggcggccaactcgctgaaagcgatgatacgagcaacatgatctgcaccgtacatctcaataatgtgagcaatgacttcctctcggccttcaggagatacgtcaatatcaacatcaggcattgtgatacgctctgggttcaggaaacgctcgaaaaccaaactgaagcggcttggctcgatatccgtaatacccatgcagtatgcaacaatagagccggcagaactgccgcgtcccggaccgataggaataccgtgacgctttgcataggtaatgatgtcggatacaatcagaaagtaatctatgaagcccatggtttcgattacattcatttcgtattccaactgtgcaagatgctgatcagcagagcctttgtagcgtttttccagtcctgctttacacagtgctcggaagaagactgtattgcttgttacgccgtcaggcagcgggaacttggggagatggtactcaccctgcttcaaggtgacgttgcacttatcagcaatcacctgagtattctgaatagcttcaggagcaaatgcataaaagatcgcatgcatttcttcctcgctcttcatgtaccagtgatccggattgccatagccaacagctgtttcgtcatcaatggtggttttcatattcatcaccattagagttcgctgtgactccgcatcttctttattcacatagtggacgtcatttgttgccaccatctgaattttgaggtctcgagccagagcaatcagcattggcagggccgctttctgatctgtcaggccatgatactgcagttcgatgtagtagtcatcaccgaagatctcgtgatactttttcgccagttcataggccttgtccttttcgccctttaagagcaactgaggaacatcgccctgaatacacccggaaagacatacgatgccttcatggtacttctggagaagcgaaagatctacgcggggacgataatacataccgtctgttgcagcaatgctttccagtttcagaaggttgatatagccctgctggtcttttgcgagcagaacgatatggccggcatggcgattttcggacgacttataggtaatatcctctgttgtgtacaactccacaccgagaattggcttaatgccattcttggtgcaagcgttgtaaaacgggattacaccatacatgtatccgtggtcagtgatggcaagtgccgactgacccatttctttagccttgttgacgagtttgtcgattcggctgtgtccatccagaatactataaccggtatggacgtgaagatgggtaaacataaagaaaaactcctttcgcggcaaatgtccaagttggtcatttgcaattattatacaatttatataaaaaatccgccaccagaaaataaaatctgatagcggatttgtagacatatttagaaacagttctcccaaaagagaacagagagtgacattctcacaaaagagaaaaagagagacttttataaagatataataccatactctataaaagaatgcaactgtttgcgcttcttgacaattagtttgggaaccctgcttacacgggggattcgacaaaattacggtaggtgcgtccaagtatggagaatccccgcttatgcggggtgaaactgtattattctcactattcgcatcttatttggatagatccccgcttacgcggggtaaaggcttttccctgcactgcttaaaacgctgtccaaggtacatccccgcttacgcggggtaaagagataaaatatgaaaagattgagaatgtctcccctggggcacatcagtaagaggtgtggggagtcctattgtttatatcatacccttcaatggtataaatgtcaaccttcctaccattttcgagagatgcgcaagatgcacatatggaggagctttgtttgcttttcgagagcgattataatataattataatgtattagtatgttttggggagctgtgacaatggctatggattttcaaaaatatttggatgatgcgttttcgaaaataaatattgccgatttcttagagccggaacccgaggtgcctcctcgggatatttaccgagagattcgagaactcattatttatgagcgcagaaaacaggatatctctcaggaagaattggctgaaagatccggattaacaccggaagaactcgtcaatatcgaaagcggagttgtacatccaagtatcgagactttgcaggagtttgcccgggcactgggtaaaaggcttgttgtcgattttcaggacgaggacatatatccttaattttctcttgccctatgaggccatgcgtgctataattgcaacatgaggcgttcatgctgttttagttttatagttttatgctgaaggaggtggcacatgtacatacaggaactgatacaggcctcccatggttttgtcgctaagactgaccgtgaaaacgaagaactgtacttacccgtatggatgcatgctttggatacagccggtgttatggattatctggtagagaaatggctgtcagaaaatacggtgcgacatttaactcagtcgatggctggtcacagggaaacgctggctggactttgcagactgttggcattgataaatgatatcggaatgcatacagctctgttccagtcatctattcgtgataacattccgggatatgagctctgtcctttaagaagagaacaaattgcatgccgttcaggctatcccctatcgcacgctcgcgccggagaagcaatccttttgaaatacggttttcctccttcgattgctgccattgtgggcgcacatcatggagtacctcaaagttccggtgctgagtctgaatttgacgcaagtccgcgtaatttcttcggtaatctctctgctcttgaatgggagaagtattgggaagagtttatcggagtcgcattaaggatgtgtgatttccgttcagtagcagaacttccgaatatctctatgccaaaccaaatgttgcttaccggattgcttataatgagcgactggattgcaagtgatacacactacttccccttaatctccatcgaggatagcggagatgctgataactaccctctaagagttgatagtgtatgtgagcgtcttgggttggactcgacatgggattacagagacaccggaaaatatttggcgcagcaggctcctgcaactaacggtgttcatcagatgcttatttctgctgtaaaagaaaacacacatcccggtatttttatcgttgaggctcctgctaaatacaaagtagctgacgcggccgtaactgctgcggaaattttggcgaaaaaggtcggatgtcgcgggctgttttatggattaccgatagatacagtatcacatgaagcatttgctgaggcgaaagcgaggattgcatacccttctgaaaacaacgacgatagcttatctgcgcagaattggttcgcaaacgtgaaaaaagagatgttagctcctttttctgcaaagagcatagagcctttgctcatgatgtcgttgcaaagcaagcatgtaatgctccatcatcttggattgtcaggtaaagtggttatcattgatgaagtgcagctgtgcaatgcgcatatgcaactctttttgaaccgcagcttaacttggctgggcgaatatgaagttccggtaatcattatgtcttcttctttgccgcttaaaagacgtactgaaatgataggagcatatctgcaaggattgtcgcacagtaaaaagaagttcgttctccctgatgatgagtggaagagcaatctttcctatcctctgattacatggacagatggaatggcgattcagcagacatggctggatgagttgcttccgtcgaaagacattccgattgaacgagtctcgagggattcctatatcagcaatattcagtcctgtgcaatggctggcagatgtattggcgtcatactcaatagtatagatgacgcgcaggatacagcaaagaaactatctgaggaatgtcctgatagaaatgtaattctttatcatgaacgcttcttggctgaagatctttataggcaggaagcgaaggttctggatgctgccggggaaaaatctacatcaccattcagagataaagcgattatcgttggcacacaaagcctattctctaaccttgatgtggactttgaccaactctttatggacacttgcccgatggacctgttattgagggggctttctcatatacatcgatacgagagatctcgatccggattgatggcatttcctcgctgtgtagtcattgaaccgccaaagaaaaacgccaactacgtttatggcgaatggccaacacatcgtactttagagatattgcccgatagtatatcctttcccaacgacatcccacatcttatgcaggaagcatttactcctccggatgtagacatgctgccgatggatgataagatgatctgggacaagtacgttaccgactacctgtcccccagtaatgcattcttgctgactgcacctaagtatagccgtttctttagtacgatcaatggcattattggtgcaatgcccggaaacacagaaatgagtttgcggtggagcgttatatctaaaaacacatcgtttgtagatgcaattttactgaagaaagatgaagacggtaagatcgctgcattccataaccccaacaagcagttcaatcctgcatttgagctgagtaagtctgaatgcgagattatcagcaagcagcgtatacgtttatctggatggctttgccgctcggatttcacagaagagattattgccaaatcggcttttcttagtgagtggcagcggagaggccctctgaaaagagatgtattcctcgttttgaacgaagacggaggcatcaaaattcagaatattccatttgagtattccccacagtttggattttacataaagaagaaggaggcgtgataaacaatcatggagaaaatagagtttaacttgatcgatgagccgtggattcgggttaaccgtcttgacggagaaagagaaatggtttctctcaaagatgctcttttgagagcacacgagttctcaggactcgcaggtgaaatgcctacacaggatgttgccattctgcgaacgctgcttgctgttactatgacggttttttatcgagtgaacgaagtcggtgagccggctccccttgagaccgaagatgacgcactggagcgttgggatgcactatgggcaaatcgcattttcccgccgcagcccattattgactacctcaataagtggcatgagcgtttttggcttttccatcccgagcgtccttttatgcaggcgatcagcgcagccaatggtacggattgcggtacgccgaagctcattggtgaaataagcgaaagcggaagtaaaccccgcctttttgcttgccgtgccggtgaaggcaaagagaagattccttatgacgaagcggctcgttggctgttatctctcaatgggtttgatgatgcagcgttgaagccgcatattccgaaggatcagcgtgaagctactattacggtggcatggcttggaaaacttggcctggtgtacgcaaagggagaaacgctgttcgaaaccctgatgttgaacctcactttgttgaaggatggccgtgagccttggcctgaaccgacccctgattgggagttggagaagccgcgtagtcttgagcttcgtaaaatccctctgccggctgaacctgctgctctttacactttccacccccgactgattctgcttaagcgcgcgaagggtttcgttaccggatattctatcctttgcggagacacctttgacggacagaacgcatttacggagcagatgactgtttggcgttatgttccggcaaagaaggagcaggccgcttacttctatccgttggcacattttgctgatcgacagatgtggcgagatatcggtgttttctataatacctcagaaacctctaagcgtccgggtgttgtagagtggatttgtacgcttcaggaaaaaggaatcatctcttcggatgatatcattcagtttgtacgagtcggcaacagatacgatatcagcatgaagagttgcgtcacagacgttataacgagcaacctgctatttcattcttccctgcttaagaaaatgaatgatgcatggagaaatcgtattatggacgaactcggaaagtgcgaagagatggcatttcgagttggtttgctggcaggcaatctgtacgttgccggtggcggaagtacatccaatacgagcgggcctgctgaccttgccaaggagcagtggtactttaatttgtctgaaccgtttactcagtggcttatgtcgattgatccggaaaaggatgatattgatgtaaagaccgaagaatggcatcagcagttaaagaaaatcgcattctctttgggcgatgaactcgtatttgacgcaccgcccaaggcactgtttggccgtacagttaatgtaaagtcgggcagcaagatcaaacagcagcattattccgcgcctgaggctttggcctggttcaaagcatttcttttcaaaacatatcccaaaaaggaggaaaattcgtgagcgaaaacaatcttcccaaaagccggtcacagcagctggctgactggaccagtaaacgtatttatcacatcttgtcccttccgggcaacggcagcaaggcgatccttgcaaatctgcggcgtggtgtaggctatggccccggtgaagtcccggctttgtggggaatcatttttgatgatttcaacgaggactggctttcccgtacgggtgaacccacgcaggaagaatgggcagtatatatcgcactgacgctctttgctcttcatcagcagagtaaggacccctcctcttcctcgatgtaccagaagggctattcccttggtcgcgcgatcagcctctactgtaagggtgatgaagatgagcgcgaacgctttcagcgccgttttgagcagatggcctatgccaccgatattaacggtgtaagctatcaccttcgtcgtattgtctatttcctgcgcagcgctaatatccctctggattacgcctcgctgacccgtgacctctatcagtaccagaatccggatatggtagcaaacgtgcgccttcgctgggcacaggacttttaccgcattcccgataacaaaagcgaataagttttttgaacaatacacatatagaaccgaaaggatgcaaaaagatcatgaacaaagcaaagtatgttgatattcacgttgtccagaccgtaccgcccagctgcgtaaaccgtgatgatatgggcagcccgaagaccgcgctgttcggcggcgtacgccgtagccgtgtgtcctcccagtcttggaagcacgctatgcgcaagatgttccctgagatttatggtgaggagttcaccggcaagcgcaccgttatggtgcataagctggtagttgacgctatcctgaaggaggagccctcgctttctgttgaaaaggcagagaagatggcagcctcggctctgacggatgcaggcatcaagctctctgcggacaacatcgcagctgctatgttcttcatgagtctggcacaggcagatgcactggcaaagctggccattgccggagagacggacaagaagaagtaccagaaggcactttctgaaaatccgtctattgatatggcgcttttcggccgcatggttgcaagcgatacttcacttaatatcgatgcttcggtacaggtcgcacatgcaatttccactcacgccgtacagactgagtttgattacttcaccgcagtcgatgacgtactgtcttctgaagaaggcgctactgcaactcgccacctcggcactgttgagtacaactcttctaccctttatcgttttgcaacggtaagcctgaatgatctggctgcaacgctgggtgaggatgaggttgtcaaggctctctgcggtttcgttaaggctatgatcgtatccatgccgaccggccatcagaactcctttgcaaaccgtactgttccggacgccgtctacatcactgtacgtcatgaccagcctgtaaacctcgccggcgcttttgaaaagccgatttccgcaagcaacggcggcttcgcagagccttctgtaaagaagctgggtgaatatgctcaggaactctacaagacctttgccccggcgccggaccaggcctttgttatcggcgaaggtctgtctgatatgggcgagaagggttctctgcaggatatgctgacttggctcgaaaaggttgttgcggaggataatgtatgagcacactggttcttcgcttggctgcacctctgcagtcatggggttcagccagtaagttcgacatccggcgcacacataccgaaccgactaagagcggagttatcggcttgctgatggctgcgcttggttgtccgcgagatgatgataagaccattcatcttttggactccaaattgcatatgggtatccgtgtagatcgtcccggaacgattgtgaaagactttcacacggtccatcctgcaaaaggtgctggatatgttacctacaggcagtatctgtcggacgcggtctttctcgtaggactggaaagtgaagatgagaagctgattaagcgccttgaaaaggcgctcaatcagccggcacatccgcttgcgttaggacgtcgtgcttgcccgcctacccttcctcttgtactgggagttaaaaacaccgatttggaaaagaccctgcgcagtgaagcctgccaggatactctgtggcgacgtacatcacgcgataaagttgcacgactgtttgtagagtgctccaaggcgccgcatgatgctgttgctcgacaggtacagggggcacgtccgatttctttcaatccggagcatagagaatatgactcctatatgttgaaggatctcggcaacgtggttttcccgcagattaaaatgagtaaccatgacccgttcgctgaaatggcgtatgaagatggaggtgaagaataacatgtatttatcgagagtagagcttgatccgcacaatcgtcataccatgcaggctctttccaagctgaaccaacttcatggcgctgttgagtcggcgtttccctttgagcgcactcgtaagctgtggcgtattgactctctgaatggcaagctgtatcttcttatggtaagtccagaccgcccgaattttgaaaatatgagtgcacagtttggcaccggtgtagagggacaggtttgtgattatacgaagcttctgcatcgtattgagaataaaacggaatggcagttccgccttacggcatgccctgcaaaggcatttaagcccgaaggatcccttaatgtacgaggaactctccgtgcatgttgctctgttgctgagcagattgaatggctcaagatgaaggcttcgaagaacggttttgccgtagacgaaaactcgttcacaatcactggtcagaagtggtatggcttcaccaagggtgaacagcataatcgtgtatccttccttgctgttacttacgaaggtattcttcaggtaacggatgctgatctgttccgtaaagcactcacggacggtatcggccgcgagaaggcttatggtatgggtatgctcactgtcgtccatgcctaagagaaaatcatagctcagttcgtgagagcccccgcattcttgcgggggcttttctcaaaaataaatcgccgaggaagtgccaatagtggagaataagtattggaattctgggaaatcgaatgtccctccaaatcagagaaagaggtgcaatgtggatataaaagatagatatgggacaacaatcaaagagggagacattttggtttatcgctatcccgactcggaggtaggcggtttaaaagtgatcaagaagcatgatattttgttcgttgaaaatacggacttctttggtcgccaacaagacgccattccattagcttctaccgacttagaacatgtcgaggtacataagagtcatgcggaggagcatttgtattccagggaagagaaggtcccgtcagatcagagaaagagatataatgtggatataaaagatagatatgggacaacaatcaaagagggagatattttggtttatcgctatcccgactcggaggtaggcggtttaaaagcgaccaagaagaatgatactttgttcgttgaaaataccaatttctttggctgcgaaccagatgccattccattagcttctaccgacttagaacatgtcgaggtacataagagtcatgcggaggagcatttgtattccagggaagagaaggtcccgtcagatcagagaaagagatataatgtggatataaaagatagatatgggacaacaatcaaagagggagatattttggtttatcgctatcccgactcggaggtaggcggtttaaaagcgaccaagaagaatgatactttgttcgttgaaaataccaatttctttggctgcgaaccagatgccattccattagcttccaccgacttagaacacgtcgaagtatataaaagtcatgcggaagaattcaaagataaagaccaataaaaataagagcagggccagaagaaatctgtccctgctcttttgcgttgcatctcgttcctatgtcaaagcaagttttcggactcatcatcgtcgacatattagagcgattcgaagggaatactctgctctaatcgaatagagaaatttgtgttggttgcaactcgatctccgagtacaatgccctcgtttcggcaggacatattgctatgagtttctcgagttcttccttgctctgaacatgcacggttttgtggaccggtgaaaggtaaatgagggtcatcttcccctgctccgctaagtctgcaatacttcgaagcgtgcccttgctgcggccgtcccatatcatatatccgtaatccgcatctcggcacatagcagcgtccttcttgctgtaaaactcgaagtccttaactgaggcggtcacaataatggtttttacgggccaagcgccgatattgtttctcgggaggccgttgttagcgtaaactgaaacatctcgataattgttatggaaacataatttctggacttgtgagtctacaccatagcaatcccctaccagaatggaatagcccttctcacaaatcgacgaaaggcgccgctgcacttcactgttgagagaggatatatttttagagcctgcgacaaacaccttcatggggtaatctccttttgcgataattcttaccggccaaccatctttgtaatctcatcgagaaactgctttccatacataatcgacaaagatattccagttgttcgatatctgtgaataggcgtcaattatggtctcggcaggtgctttagcaaaggtcggttcaataataacctcccattcgcttttgcggttgaagtaataaagtgttgctttcctcagttcttcagcaaattcatctttggtttggtgctggagtaagagctgtttcacctcgtcgctgaacctactgtgctgaaatatgttatacactttgattttgccattgcggcatctgtaaacattccaaactagcttctccacattaacacctccattacgcttctatatttatattatatcagaaaatagcgaagacctctacccaaaacgaattgaggtcttcgctatcatacttattggtgtacgccgtggacgatttgcctacaaatctgttcaggtgtacagttgctcgtgtcgatttccatggatgggatacgatacctttgcagaaaataccgcatcttgcgcagtcgttcctggttgtccaataccttcgttaagtcgggatcagtggcattacggcctcgaatgcgctgtgtaatgattcctggaggtgctgtgagaagaactgtcatattcggaatacgcacctggttgaccagcacatcaaagagaacattattcccctctgcgctgttccacgcataattggatagcaaatatcggtccgtgatgaggttttgtccagcatactgttcgctcaagcacattaaaccggttccgtagaaccatgctcgtacattgaccgggcaggaattaacctgcctggtaattacgctgtacgcatcttccactggcagcgtatccagcaatagatggaacggcttttcgacaaactcacactggagctgtccggcaagaagtctggctaccgtagtctttcctacaccatctacaccttctattgcaatgaacattttgattactctccttcgcaatctacttgtccacaatttggccgacgatgcttcagttcctcacgcttgccgaaagacatattgttctcctccgacaggtatccggagactcggcgtaggcgtttaatatccttaccgccacgaccgcatttcggacatacagtaaaggttccgctgtatccacaggggcactcatcgagcgggtagttgataccaaaataaccgatgttattctcgcaagcatattccacaagatcctctatcgcttctccgttggccatgggggcttcagccagttctacataggagatatggccaccattgcacagctcgtggaacggagcttcgagctcaattttctcaaatgcggatatgtttacatacacgggaagatggaacgagtttgtgtagtaggtcagattctgcagaatcgttcctgtcggataaattcgactcgttttcttcggcaacacacccgagataccctctccagaggaggccagcaacgagaaattcatgttggttgcctcggcaaacaggtcaacaatctctcgcatatgtcgtacgacttgcagtccttcctgtgcgtactgctgcaataccttgaacggcacgttgagcatcttgtgctcctcagtacacagcagagaactatcgtcatgcagcacgcaaaaactttcccacagaccaataaaaccgatggaaagagtgccgtttttcagcatgtctgctgcgtgagactgctctgctccctgatacaatgcatgttcctgcacatatttcagaccgctgcctttcaggagtttctcgtagcggtcaagcaaaatctcctttgcgttctccatctctatatcgatgagtcgaaggaagcactccatgctgttgccgctttcaagcgccagctgtacgaggttgatagaaatcgctgcaatgttgcctctatggagggcgcccttttcggagaaacggttctcggcgatacggctgcggcatcccataatgccaaatttctcaggtggcatggtcctattgaacgttgagtccaaattcaagtaggtcgggttcattcgatgtgccgttacctttgtagcttctctcagcatattatgagccggatcagtagcgcgacgattgataccttcctttacacaaaatacgaggttcgggaagatgtagctgccgctttcgtatgccttgagcaaagcagaagtgatacgctgactgtcagccgaaacgccagttccgaaattcagagtgacataagccttttcgcagcccttacgcagtggcagattaagattttcgagaaaatccgtcatgtgctgaaccagcacgcattccttttcgtcttgcagataacgagccaggccttcatcgaagttcatgacaccgataccgccagattgctgattggtcagctctgtaatgccacgaaacagacggtttagtgctgtatgtatatcgcatgcatcctttgcgtaatctgctacctcgatgccgatgcagttgtatgcggtcgtgtagaactcaagatcgtggatatggagccgacccttggcatggagttcgtacagttcctgagggatcacgtctcgcagggcttccttcaaactctcagcgcctgcatttacaacgactgcggaagcgttaacttcgcagttcgatagctctcgttccttgttataaatagacataaattaggctcctcctctaatttcctcaaactgctggttggatgaaccgacaaacggcttattgaaagtacggcactcctgcttaaaagggccggttttcaaatagtggagattgtcgatcaagatttgcggaacatccgacctttctgcgccggtgtacaagcagatatcaaacccaagattcttcagctcggtggtgagtttcaagacgacgctgtactgctccagcggatcaccgccggatatcgtcagtttgcggttcttgcaatgctccagcaggaatgcgattacgcaatccaactcacaaagcgtaccgccgtccggggtgttgtacttgctgttgtggcagcccgggcaattacggtggcagccctgtaaaaacaggacgctacgaatacccgggccgtcaccggcacttgttttgatgaaacctgcaacgcgaatcttcatgattttcactccttttcgggactaatctttctcttgtttgtgctttaagtataagtcagtcgccctttgaagttgtgaaaagcaaccttgcgttgcgaagagaaggaactattttttaattctatattttgttacaaatcctccttaaaatcaataatatcgttgcgtttatgttttaaaaatgttccgcaaacagaatgcagcttcggctctgtgtcaacagtaagagaaaatattttttcacaaacagagactatttcgtccagagtgtcagcatcccatgtttcctgcagcaactggatgaagcgttcctgcaactgccccttatcatacgtcatcaattcgggaagtatcgtgcaacgaacatcctcatcttccactaatagcagagctcgcaacatccatgctcgacaagcacggtccggttgctggcattcttcccactgttcagccaacgacttagcgatgtattctggatctatacgccaattagagttaatgcccgatgctcggtaggattggagtaacctctcaatgcgttccaattcttgagatgcttctacgagctcattctgctggacgtaaatatgcactttgtagaaaatattgcttatgaaatctctcgttgagagatcagacgtcgtatcaatcaatggtgcccagagtttcaacgccctttcatagcaatacagagaagtttccggttgttcattagagcaagcctctgcgtaatggtgccagcgctcgatggcataaccccagtttccgcgtcgttcatccttttggccaagcaagcgataatcgcattgttctctgtattgtttttgaatctcccaagggaagctgtcatccatactagcggcgatatatgcctctgcctttgctcgcagatagggttcctgaagcatattgtccttcatatagccccaaatgaagtgaaggatatcattaaatgcaggcaacagttcattctccgaagagaagtccaaggcgcgtaacatgacagcagccctttgctcaactctcgggagtggtgctgattgatctatcacttggttaagcgtgtaggtaatcatatcctcatctctcgatttactgaacagcttcacagactgaagcaatcgaacccagtttgttttcttccccggttgtaacgccgattttaagaagaaatatgccatacccgctcgatctgcaagaagcggttgctgcgaataaatgtcttctgccatctgccagtagtgtactttttcttccttgtctgtcaacaattcagaataatgccagtaaaggctgggcaagagagcagtatattggctacgttcttccgacttttccctttttcttttccagtcaacaatttgaataaacttcaagcaataactttgagcttgcgccaaatcgccgtgctcgaggcagatgtcgataatctttcgatatatctcgtcatctgcagacagttcatttcggaggtcctgttcgaatatctcaagtgcgtctttccatcgaccgacttttagataacactccgtgacatcagttatgccccaaagttcatctccttcttcgattataagatcatagcattcggcagcggttttataatcgccactctccattgcttgggttgcaatctccgtgtattctaattcaggattgtcacaaatccatactccatcatcgctgggcttattcagagcatgatatagtttagcatagtgtagcttctttgagagatctctgtgattatcccaacgatatatctgggtaaaatcatcttccgcgaaaaacagtgatatcttttcatatgcacgttccataagagctcgatccacatggtttttctccatatatgttacggcttcatcgtatttttgttctacgaaatcatacccctgttccagtatttcatcgtccatggtgtaagtcgattccaatccgcaaatagcaccttgtgcatattccgccagattgagtttgaaacgagctatatcgttcggtgtttcaacgcactgctctgcatagtctgtagatgcctgaagactatcgaatattttttgcagcagctctgactgtttctctggattatccatgtattcaattatatcaatatccgatgaggactccgttgcttggtataaatagagcttgcttatttcctcgatgtattgcgcaggttctttcaggcatagatttaagcagcgttctacgatctcgcaccgtctcgatacatgttcggtatattgcatatagtagcgaatcagagctggtgtatctccggagatgcgggcattaaacatctgcattacacggcgacgtacagaactttccgtgtagttacagccgtcgatggtttccgcataaccagccattgactctaccaactggttgcaatgttctgcattaggtgccagatggttatacacgagatcaaggatgatctggtgcagcataatcttattgtcgtatttctgaatccagccatgccgcaccagagcttcagcgcaggcctcttcgtccgtcatgccaatccaatccaagaaagcatcctgatcaatagccagttctcccaagagagacaagctgcgcagcaaggtcttttccggctcagtaaatccagacagatcaaacagggtcagcaggtgtcgttctacgctctgcggtcgcagctgacgatccttcctctgcttgatattcgtatcgtccagctccgtcaagccctcggctttgcgcattttacggtagagttcgtatggagactcctgcgtaatacgcaggtactttgccagcagagcaatcatcatcgtatggaagtctacaaacccaaacaaacgatagagtgtatcccactggtcttcggtatattccgtgtcattatagtagccaaacagcgattgaagagtagaacggtccttcattgctcctacgtccatctgccggtaatcataatccctgtagtcttctcgagtggtgataaggaatttacactggcattggagcaacgtctccaggtcgtcgtctttctcaacatcaaagttgtccagtaagaacaaatcgtcaggagtcaaacagcacttcatctgttcgagaagacgtttgaagtacgcatcatccttctcattctcttctcgtttaaaatgctcgagttttacttcgttcagcagggtttggcgtatactcccgctgaagcggacagcaacaaccgtttgcagatcggcgcgatgagtatggatgtagcggttggccagttctgttttaccgatgccaccaacaccgtgaagaaataccacatgagactcttgaaaatattcgtgaatggtctccagctcttcttcacggccgacgaagcagctattatgataagtgaaattgtctctcacatataccgcatcgggcacacagacttccatgagattggtcaggaggtctactacctgctgcatggagtcacagcgcatgctttgggtagagaccatggtgtgatggaaaaagtttgcgagttgtgtaaaaaagcgcggcggataggtagcgtacgtctccttcagctgatccatatcgaactttgcattatgccggcattcctcaatagtgggtgttcgatcaaacaaccgaacgaatagcattacaccgacagaataaatgtccgttttttcgttgatccgctcaaggcgatactgcatcagctccggggcgcagtaatttggcgaatacgaaatgcggcagcacttcccttcccgcaggtcctgcttctttactgtggagtcgaagtcaaacagagctaccaattcgtctgtttctgggagcagcagtatgttctctggtttcatgtcgaggtatagatacccggcgtcatggtacttctgcaataccgttgcaacggaacggatgcgctgtatcgcctgcttgggcgatgagtctgtcagtttgtcgtagctgttaccagtctggtagtccatcacaacatacagggtattgttggcctcgtacagatcgtacatatgggcgactgagtttgtaagacctgtctcattcatcaggtatccgttcacctggaatgcattacgaaacagactctccgcttcttcaaactcagtagcgtcctgctcggctacgcacaactgtcccgagtcctgacgcgtaactggaattgcatatggatagcactccttaatacgcaccggccgtggttgcccagtggaagatatgtattgcgcatcatacacgatgcaggatgcaccgcgaccgatctcctgaaggatggtatagtccttcaagtccggcaaatggagtacgctttgtttctttaatgcaattcttgaatccatagacgacacctcgcttgttcaatgtgattataccatttatataccaaatattctaccctgttccattcccattctctgtggtataatgggagtatcctagagtatttaatctcggaaggagcatgcaccaatgacccattcctatacatataagcatcagaacaacctttctaatgaattgctgttcgatgaaatgcctatcaaagatgaagacattgccgaagtaacatttcggcctttttctgaaagcctcacattcctcatgaagaacgcaggctatacaggaaaagatactccgaccgataaggctgcttttgtaataggggcgctgcacgacataggcctcgatgttacacaccaaaccatattcgactggtttgagggtaaaaccgtcccagaccatacgaaagacagtcgaaagattgtaatcgctctatgctttgcattacatcttaactccgagcaggtcaaatatctgttcgagcatgtgtgctttgaccgagccctcaactgccgagatgcgagcgaggcaattttcgcatattgtctgcataccggtaagtcttactctcatgcacgcgaaatgattgagcagctgccggctgcgtctgcggcaccagatccggatgacgaggttccctataccgctgaactggcacgagaggtcatgaagttccgtgatgatgtagagctgcttcagtacatctctaaaaaccgcagccggttctacgtaaacaattattcggctcgggaacagctggataagctgctgagtgaggtgcgaggatctgatacagatgccgaatactttcgtagtcaggtaaagctggtaaagcagcatcgcgcgacctctgcacaagataattccgattgtgggtttgtggtaagagaggcgctgtcaaagatctctggtattgaaagcatagagcaattccagaagaagcaggtgaaatccatagactttatgttatggatcatcttcgattttgatgcgcattccaaggatcttccgagttttcagaaggatgctatgctcaagcgagtaattcggcagaactttccgagcaagaagttattttccgatgtattgaacggtaaaaaccagcagtatgacgctatccgaaaggcaattatacttttgaagttttaccagttccaaatgaattgggaactggacgagaaaaatcccccggaagatgaacggtacgataactttgtcggcgaaatggatcatatactggttagctgtgacctgccgttgctttatgctgggcacccatatgattggatcttcctctatagttcgaagcaagaagacccgctcgcaacatttcgcaacattctcagcgatgcaattccagagttctcttaatagtatacatgccggtctggcgatgttgtgaaaagcaatttttctcatgtcgttcttgaaccggagctgtcatcaaatatgaaaggtacatagtatcgagatactatgtaccttttgtttctgcaacaaaagaagaagctccccaatacgccacatccgcatggtgcattggggagctaataaaaaacgagggcgccgtagcaacgccgcccgtacaaaaactacaagtagttttttgatgataaaaagtcaactgtctacatatctacttctaatcgtggtcgatctccccaattatccggatatttaaggaggtcatactcgatgttcttcgctcgataaataattttgctaaacgaagtctcatctgctccttttatatatgtagcaataattctataggaatcacgtatattatcttggatattaccctcaagcaaagtatctggcaaataatctcccgatcctgtaacatctcggaatccgagagcccatttaaccccaccaacgagtttctccgtatataacaaagggtggaaattattatagtttcccatcgattttgcagacaagttggcatttttaaacaccaatggcaaaacagtcaatttctgatgtgtcgttccattctttgcgaaatcgatatctgtttcttttaaccgtccatttacacaaaagttatagaaatcaagatgagaccattctttattggtaagcaccaaccctgttaaatggtgaaaattactcgcatcaaatccaacttcaagtgataaaacacttttatgtttatcagtagctacaaaaagtaatttcttgccggcaaaattgtctttatataatcttgctgaagatattgctattgaaacagcctctttctttgtgaactttttccccatcgttatcttccaattcttttctcaaaatttaaagggagactacaacaccgcagtgctgtgcgcctcccttaatgactgattttatcgttgtccgccaacactccagcccatacgtctggaatcgctatcaggttttatcgttgcctgccaacactccagcccatacgtctggaatcaatatcggatttaaggtgtcagccacaccagcaggatgtcgcctgctttcctatacatattatactcaaaaaaaagatttttagcaacagattttgaaaaatttttgctgagtttttctgaataaatgtgatgtgcaactttgacaacaaggagcatatatccccttccttatgcgagaaggaaaggctgaatcccggcagttcaattgttaacctcttggtcgttcgttcgacaacctgcattgcatctaactctgtaaaaattgatccctttccggatttttcggaggatgcagggcattctagtgaaatcttttcgcggtttttccagacaaccaaatcattctatcctgtacttctatcatatacatccttcttgcttcttagatttctcgaccgataaatttatcgccatttctccgttgctttctattattatatcacttcttgattttttgtacaatcatattaacggtatacagagtgctaatccatagcactcactccgtaaggggtgggaggacgtcaaatcatatttctttcttttttcttcgaggggcagccttttagcgcagcctgctttttcgtgagaagacttttggccataggcgctgaaatacccttcttgccgagtgactgcaaaaacttattctctttccagatcttcctgcttgccgataacgtatgaggaattgacaaagaaagcgtcttcctcacgaagccccatttcgctcatgacctttcccattggggctccctctgctaacagtggatcaagcacatgatacatagggttctggctgatatcgaaagccctcaccacatcttcgccaaatctcttggtcgccatttggataatgctgataaagtctcggcgataagctgagccgtcctcgatcgttgcgccgatcatgccaactgtacgcttctctgtatccgggttaatcgcctcatatatgagtgtgcatctcacggcgcaaacgcctccttcttgaacgaataaaaggtgagatcatttgttagcatgttcacgctgaacttcgcgttcctcggcgtgcgcaggccctgcgcgttcatctcctcggcaatggtcttcagcggcttgcccgacgcgtattccccgaacgcccactgcacgaacggcgctgtgttcgggtctgggatgtacttcttcgtggacctgtccacgtcgtagctgaacagcttgtggccgttgtacagggtgtgctgcgcgttgtagccatgccgcgccggatgttctgcgacagctggcggctgtaatactccgccatggcctccatcaatccctcgatgaggacgccttcgggtccctccgtcgggatgtgctcggccagcagttgaatctcgcaccccgcgtcgcggattttcttcttcgccatcgccagaacgtatttgtcgcgtcccagacggtcggtcttccacatgatgagggtatgaggacggatttttgcgacttccgacagcatctgctgaaaccccggccgtgcgtccgtggtgccggatattgccgcgtcctcatactcctgcacgattttgaagccgtgcgcatccgcccattcgtgggcaagctcgcgctgctggtcgatgctcgcgtcgttctgcgagtggggcgagaagcgatagtacgctatcgcaaggttgttgtcgttcggcgcgaatttcttcttacgtgccataggctcaccccctcccgttttttctgcttataggctttcacgttagttcctcctatatgatgaattgcgtaaatatgcatttaattataaagcccgccgccatgatatggaacggcgggcttgcttgtcattgtctgattgactgcatagcagccaaatcggactttgcgctttccattatcgttcgcatgtacttgtccatgtaatcccaatcaggctcgcccgatgcattggcgggcagggtaaggtaatcgctttccatgacgtccttgccccatttatccccgaaagagtacggtctgcccgcttcccaaaacagaggtgcgagaaagagcgctatgtactcagtgagagaaaacttcggataaagcacgttgacgtcatcggacgcccagaacggaatcggctggtaaaacgctttgcccgtcgccttctgcccgttgtacgcaacggtcatgagtcctccggggtgaacatggccaatgttgctcactcgtgccgttatgccgttgttttcaagggttgcaccgatgaacggcgtgtctccctctatcatcgccgctctggtcagacgcgtgcctttttcaatctcaaataggctgccgatggagaactgacgccaatcggaagcattggctggatgaaactccttcttgactttccccatattctcaaggcttgccccagattcccccatgactgccgacatgtactcatccatgtgagcccaattaggctccccggacgcatcgacaggaagcatcagttccaaactaggcaacacggtacttgaaatctggtcggaatactcgatgctgcccaaggcggctttaatcatcgttaccaaaaaggacgcaacacgttcgttcaattcgatattgagcggtttcaagcaatgtactttcatatccaaagaagctctacttgcctggtaaaacaccgtcccgagaaaactcacgctgataaagtttttataaacgcggtagtttgcgtcatcaacatccttgtaatatccggtgatgccattattaacacccgacaccgtgatgcgcggcgtggaaccgggcataagattctttgaagcaatccagcttccagtcgggacttgaatcttacgacccattttctcggtttcgaacagctcttcgactcgaaatattctccacccgcttgtatcaatcttcgacatcgccaccaccgcctttccgcatggtaacggttactgactcgttatcggcactcacacggctcgaatacatcgcggtgtccagcagcttctcgccgaacgccttcgcgtcgataccctgccggaacatcaggtaatccattgccgtcttgcggaagtcctcctcgaaaatctcgaacggcttctgcggcatctgataggacaggtgctcggcgggattcacccactggcacgtatcatcgccagactgcttctcgaccacatcgacccaatgagcctcaatggtagcccacttgccgtagacgtcgtggcgccccttgttcttgaccgtcgccagaccatcagactccatgtagcaggcgaagaactcccttccgtcctgtgcaactcccgcctcgaacacgaagatgctcgtggttatgcccacgccgaagaacaggtcctccggcaacttgatgaccttgcgcaggcggtggttcttcagaatccgcttcatctgcgtcttcgatgccttctccagctttttgtccggcagaataaacgcgcattgcgtgtgcgccggaatgctgtcaagtacattctcgacgatggtcatgcagccgtacttgttctcgtatggcgggttcattagcactttcgtaatcggcttggactgcatccactcgcaggccgcctccgagcgagtatccatctgctcgatgttcgtcttgccatccttatgaatcagcatgttcgcacacgccagtgcgtaaatctcgcggtcgaactcgacgccatagagctgtttggacttaatctcgccggccttcttcgtctcgacatgtgtatcactgtccaaactcatttccatatcttcctcaataatcggaagcttgaatttgatggatttgagccactgaccgtttggctgtcgttcctcatagatatggatttcagaaatcagcgattccataatctgtcgcttctcctgctcgtccatgacagcgtacagcttttcaaaataaatcagcactttgtagatattgtcagcagtgagtttttctgcttctattgccattttctttgctctggcttcaatcaacagattctccgtatcctctatcttatcatacattttataaaggcgatcatcaaggtctgctttacgcttgatgtagtgcttatcatctgggtcaagggtatcaatctcatcaatcaaacgggacttcgtagcatagctctgacgaagctgtttttcataattggcaatctcctgttcaatggcggatgtatctatcttcatattgattttttgctgcatcatcgccgcaaacttcggattgctgaccagtttgataataacctctgcaacagcaccgtccagcaattcctcattgatttgcttcttgtattcacacttatgaccacgggtcatagtgcggtgtttgcagccataatagaagaaatccttatatttcgtgccgtccggcttgtgcttgatgcttttgttgccgtacattccggctccgcaaataggacatttaagtaatccggtcagcaggtgtaccttgttgtctttaccgttgttgaccttttcatacttcttcgcctgagcaagaagttttacttgggcttcatgccagagtccttctgatacaatggcttcatgcagaccgtcaactaacagataattttcctgctccacaagtcggtaatcattgcgagttccatgtaccttttctgttcttctcctgccgtaagcaattttaccacagtaaacgggatttttcaaaattctgcgaatcagggctgcatcaaacagaggattttttccattctgccgctgaattttgttgataccgtgattggcaaggtatttcgcaagtccgttagctcctatatcggtatgcacatactggtcaaagataatgcggattgcctcggcttcttcctcgttgatatacagcatacctttttccaatttgtatccgtagggagcaaaaccaccgttccatttaccctcacgagctttctggattctgccttccatcgtctgaacacggatattctcacgctcaatctcggcaaccgcagaaagcacggaaatcatcagcttaccggcatctttggaagaatcaatgccatcctccacacaaatcagattgacatcgaaatcttgcatcacctgtaaggtagacagcacatctgccgcatttctgccaaaacgtgataacttgaacaccagcacataggacacgccatctttaccggacttgatatcctccatcatgcggttaaattccaatctgccctcaatggactttcccgatttaccggcatcctcatattcaccgacgatttcaaaatcgttgaactcagcataggctttcattcttgatttctgagcatccaaggagtaaccgtctacctgaacggcagtagatactctcgtataaatatatacttttgttttttctttcatatcgccatcctcatttgtgccacagcctgtggcataattcagctttcatcgtctgttattttttgccgtcagttttctgttccaacatctttatcgaatttaaataatcattttccacgtcgctgagcgttcttgtcttatattttcgatattctccagtcgctttatcaacagcctgcttatgagtaatgcttccatttccaattaaaagctgctctccactcatggtaagaatgcgatccagatgctctgcccagtcctgcatcgtcattgcctgttcacgctctgcctgacgttccgcaaaatccagatacccggatacaagttgtcccatagcacgaagctctttctcattcagatagtttttcgcaacaatcgcttctttgagtgtcggctgattaccggcaaaggtggtaagtcccatgaactctttttccgcatccgctcttgtataaatcacttctgccgcagtctgtccgtgaatggcataatgaattttattctgaacctttttgaaaaaacggatagagatttccgctttcgggtcgtagtcaatgctggtggcatagatttcaagcacctgacgataaaacaccttttccgatgcacggatgtctctgattctttcaagcagttccttgaaatatccaccgccgcccagatttttcaatcgttcatcatccaaagcaaaaccttttttcatgtattctttgagaatgttagttgcccagattctgaactgtgtgccacgcttggattttacacgatagccgacagaaatgataacatcaagattatagtagtcaacctgataggtttttccatctgccgcagttgttgcaaaatttgcaacaactgactctcgctgcagctcgccttcggaaaatacattttttatatgtcttgaaatagtagatttatctctctggaacaactctgccatctggtcaatggataaccacacggtatcctcatcaaatgtggtttcaatttttgtcaatccatcttctgttgtgtaaataatcatattggatttttgattcatatcatcataattgttcaccggaacacctcatttctaattgtgcaacggggtattgcgcttttattctatgtagctctatgcgttgagaacagtagctctcgcatagagtttggacacttattccacgactattatatcattgcttttccatcaattcaatagtgtcactgggttcttcagatgtgttttcttcctccaaacaagacggcggctctggaagattatcaatatccagaaccgccgcatatttttctattaaatttgcaagtaaatcggcaaaaccattccatttatctgtcaatagtgctctcctttctttttcgtccacgttcctgcggaatgtcctgtttctcttttcctctggtcaaaacggcattaagaaaagcccgtaccctttcaggtgcgagcttgacagcatccagatacggctgagcctgttccagaagtttctcatatcgttttttccataccccagcatctttcttggctgtttcatatttctgctggtattttaatttctccgctttttcagcaaagctgctgacagcataatttttgagagtacggcattcatcgggtgtcaagacgatgttcccggtaaaagatttcttacccatcgactccagctcctgaaccgtcaccgctattccggttgccgccttagtctgtgcttgcagggatttaagctcctgctttttcttctccgcagcctgtgtagtatcgtcaagctgtgcttctttctggttcagttccgccgtcacagcttccagtcgctgcttttcctttgccaccttaaactgggtcacagtcagatgttcctcggtgctgtcacgctctccacgttccacatcggtatatccggcagctctcatgtgctgaaaaaaatcatcctgtaaaacagaataggattttcggagaacaggcttaccattgacttgcagaattggttttccatctttgtccacagcaggtttggacagccactttttactgcggctgacctgcataatggtttcctttaccgttcctctgagagcttcatccttgcagcgtttcgaccacaaaatctgtttctccaccacagggacatagaccacatgaagatgataatggaacacgtccttgccaagtgcttcggacatcgcccggttaatctcgtcagcgtgcatgactgccgagaggatatactgttcaccgccaacaatctccacagcggatttataggcttcctcataaaactgtctggcgtattcataaccgccgtgattgtcgaagtacgcagagttcacatcaaagaccatttcgttgaaatggacggcatccgccttcagacctctggtggaaatgatgttgtcagctttcatctgctcaaacatttcagcgtagctcccggtaggttctttgaagtgtacgttgagggaacttctttccgggataatatcttcgttactgtatatttctttttcacgctcattgtgtgcctgtgcatctccgatgtcattatctgtgacatccatatttcttgcacaggtacggtcaactccgtcatttcttgccatatttttccttcctttctttgggatttgcagacaggtagctttggaaaggcacttctgcggaagtgtaataacccactatgacactttcatccatactggctgcaaagtgccgtgggctctcccgaggggctctccgagggtaatgcggtcgctgcggcgacctctgccgaacatcagaaagttgtctgctcctctttccaatgtccggcacggacggctgctgttttgcgaaaccgccccgtccgttgacagaaaaaagactgactttttcctgtcatttgggtacgtcacgaaggttttatacaggagtgatttacgctcgtacgctgtgtacgtacgtaccaaaaaatcaatcccgccattcctccggtacgtacgtacacggcgaaacgtcgtaaaacccatttatattcggacgggctacggcttcaattcccatgaatccccacaccctgcgcccggcagagtttgtgattttgttggtgtgttccagattgtagcgacttaaatttgccaccacactgtcactaaagctgcgggatttcaggggcggcagagaattttcctcacaccacatccgataaatttcgtacagctccttggagctgatggaagcatccgctttcagccggatatagccctcagactccatgaagtcgaaaatattgttgttgtcacgcttgacggactctcggttggttttggtgcgctcactttccgtgaatttgaaattgttggcaaccagacgctgcaatccctcaaacgcccagaggaaaatgccctccacctcagctttcatcttctgggcgaggtcagggtcatccattcttccggcaggcttttcctttgtggtcagcacaagctgtctgcggtagaaaccgtcacttcggtcatacaatgcctgtaaatctccattggagaaagccagcagacgggcgaacatccagccctgatagctctgtttgcccttgcgctccaaatccattttcccttgagctgtcacaatggatttcacataattggtctggcgcaaggcttccattcgcatatcatcatccacgcataggaggatatgctccagatcggcacgggcaaatcggttctcagagattttaccaatgcttccgtccttcatggaactgcccagcatttgccccagcaccgcaccgatttgggatttaccctcaccgccattgcccttaatgaccatcatcctctgtcctttattggagggaatcaggcaatagccgataaattcctgcaaggtagggatgtcctccgggtaaagcagaccattcagaaaggaaagccacagcacaggtttcggagtatccgggcgatagaaaaccgggagcctgtttctcacaatatccggcttcccctctgtaaaagtgccgtccagcatgagcgtaccgtttgccagatgaatcctgtcctgctccggcgggaagtcctccacatgagccgccagcttcataatctcaatgatgttgctgattttgcggggaatgttgttcacggcacaatatttcaattcttcaaagatttcgccacgaagcggcaggtcgtccgtcactcgaccatcaggtgtgaaaaaagctccgtttgcaaagataatctgacgggttctcagaaaatcttcacaaaacagagcttcattgatactcttgccgtcaaaccacatcggcacattcatctcaagcaatttcctgttctctgacatggcagcgcacctcctttttctgctcgtccagtcgtgtttgcattcttgcaatcgttccgtctgtcaaaagttccttgacggtatcagtcctttcttcctgatcgctcataaggagcaaatcgttcagatactccacatattccagcttgtggcaagcttccacgaacctctcatccggctcgtcctccggtgcttcgggagcatatcgctctttccagtcctccaaaagatgaagatacccggacagcacattcatgcagaaaagctcgtcctgtttcgactgattcacacggggacggtacttctttacctgtgccaccacggacggcggcctgtccagtccgaaatccgcagccagtctctgcgctgcttcataggcagacaggtcaagcagccttgccacaaagtcaatcacatctcccttggcaccgcagccgaagcaatagaagtaatcctcgttcagcttcaagctggggtgtctgtcatcgtggaaagggcagcaaatcatcccggagcgattgattttcagcccgtagtgttcggcggcttgcctaaccgtgaccgccgccttgactgtttcaaaaatgttcatttgcataacctccttgatttttctcgatgattttttcatctgcctgaatatacgcagaaaaacgctttcaaccgaaaaatcaggcacttccgcaagcaaagcaaaaagccgccccgaaaacttgaaaaaatgcaagtttcgagacggcagtgttcacacaaagttggttgatattgttccgtaaatagaatataattgaagttaatatgaatcaggagggatgatacagaaatgaaatacctgtctacatttgaagttgccgagaaatggggtatctctccccgaagagttggtatcctctgcaacaatgaccgcataccgggcgcacagcgggcaggaagccgctggatcatcccggaggacgctgaaaagccgacagatgcccgcattaaaagcggaaaatatatcaaacagaaaacagacagaggggaggaagcataatggctgatacttatttacccgccgatgttcggaaaagaatcgttgatgtaatgagagaacgcaagatgacccagcgagaactggcacttcggattgatgtgaatgaaagcaccatcagccgcttccttagcggaaagaccgaaaagctgagcgaagaaagcgttatccgcatcgccagagtgttcaatgtgtccacggactttatcttgggtacgaccgtaatcccggataaaaagaactacgatatttcagaactgggattatctgttgaagctgcaaagaatctttataccggaaaggtcaacaatgatgtagtcaaccgtctgctggaaaatccccgctttgccatggttacttatatgattgcacagtatatggatgatacccttgcaagaggatatgccgcacaaaaccagatgtttgctaccgttggctctctgctgttgggacagaaccaagctcccgaagcagtacaggcagcccgaaccgctaatgccatgaaaattcccgcttatcaggcagaccagaccacgattcaaaacacctttatgacggtggttaaggaaatcaagaaagaagcaggcagcgatttggtcgcagccaaggcaatcagcaaggaagccaccgaaaagatgtttgccgagctgaccaaggggcaggatatgcagaatccgaccatcacgccggaagcagttgttgatgctattacaggcagcatttccggtgtcgatggagtcaatcaggaagctctggacaactttaacaaagccttgctggggctgatgcagacgatggtgctgccggaagatgatggacaagataactaacgagcagctctgtattgcggcgcagagcggtgacaaatgggcagaaaacgcccttgtagagaacaatctgcggtttatccgaaagacggcatacgagatatggagcgcacagcgggagctgaacgttgccctcggcattgaactgaacgatttggtgcaggagggttcattggggcttctgggctgcataagcagctttcaacccgactacgggaacaagtttttgacctatgctgccccggctattcataatgccatgctggactacatccgcaggctgaatcctacctttgaagccaaaaatctggactgtatcattcgtctggatgaggtcaaaaagggcgagaataagggacaacatgaatttatagcagattccagagtacagaacccagagcagattttcattgcaaaggaaacccacgaagaaatccatacggctctggaaatgattgatgagcgagagaaagcctatctctggtatcgctttggctttgaggacgatgtcctccatcctctgagcgaaacggcgaagcacttccatctgtcagagagcagagcaaagtccacggagaaattggctctggataacttctggctggaactgccttggtggtactaaatattcaaagaaagggacatgtaatcatggaaaaatataaaatactcatcatcgaagatgacccaatcattcaaactgaattacaagttctgttaaacggaaacggatatgaggcatccgcagttactgactttacatcagttatgcaagcggtcaaaaatactcatccctatttgattttgctggacataaagctgccacaagaaagcggctactcaatctgttctcaaatccgcagtttttccaatgtaccgattatctttgtaacaagctgcaatacggacatggatgaattgaacagtattttgctgggtggagatgcttttatcaccaagccttataacacagcaattctgctggcaaagatttcatccttgatgaaacgagcttacccgatagaacaaattgagcgtctgaattggcaaggagcgattcttcacttagaaagtagcacgattgaatatgacggtaaccaagcagaactgacaaagaatgaattgaaaatattatattatcttttcaaacacgcaggaaagatttgttcccgtaatgatattgtagattatctatgggacaatcagctatatgtggatgacaatgctttgagcgtcaatatcaaccgcatccgggaaaaactggcgggcattggcctgacggattttatcaagacaaagcatcgccaggggtacacgatatgaacagcaaacggtattggaaaaacaggcttccatttctgctgacgaaccttgtttgcatggctgcgctcactgtatttttgctggtgtgcggcaattcggcttccgcagtagtattgatcctgatcgtatgggcattgattttgctgatgggacttgtcctcacttactggaaacgaaagcggcagatgaaaaaacttctggatatggcgaagcagctctccgagagataccttatttctgaagtgatggaactgccggaacaggccgaggatcaggtttactatcagattttgaaaatggctggaaaatccatgttggagcagattggggaggtcgagcgggaacgcctggagtacaaggaatacattgaacaatggattcacgaaatcaaaacgcccattactgccatgaaactcctatgtgaaaaccatcggacgaactggacaaaagaacttctgctggaactggaaaagaccaaccgctttacggaacaggctctttattatgcccgcagtgagcatacagagaaagattattctgtccgggaaatggcactgtcccaagtggtgcatcaggcgattgcagataacaaatatctgctgctccaaagtggtatgcgcctggaagtggaggaaatgcaggatacggtttattcagatgaaaagtgggtgcgttttatcctaaatcaactgattgtcaatgcggtcaagtatcgtacgaagcagccggttctccgcatttctactcataaatggcaggatcaggttgtccttgtcgtggaggacaatggaatcgggattgctgcgtccgatctgccccgtatctttgaaaagggatttaccggtcagaatggtcgtctgattcagcagtccacgggcattggtctgtatctgtgcaaacggctctgtgaaaagctgggcattggcattacggcggagtcgtcggaacatggcacagccatttccctttcttttcacattaactgtctgattcatgaagtgcagaactgaaaagcgttctgcacttcttacatttttgttagaactttgtaagaaaacttgatacaaacgaagccactcttattttacaatagagatcagaggtgataacaatgaaagaaattttgaaactggatcatatccaaaaatattacggaaatggcggaaatgttacaaaagcaattcaggacatcagcttttccgttcaagagggagaatttgtaggaatcatgggagcatctggctccggcaagactaccctgctcaactgtatttccaccattgataccgtcagtgcgggacatatctatctggacggaaccgatgtgacggaaatcaacgaaaaacagattgcccggtttcgtcgggagaatcttggatttgtatttcaggattttaacctgctggacacgctgaccatttcggaaaacatagccctggcgctgaccatcaacaaggttccagcaggcgagattgatgggcgggtgcgggaaatggccggaaagctgaatatcacggatattctggacaaatacccctatcaggtgtccggcggccagaagcagcggtgcgcctgtgccagagccattatcaatcagcctaagctgattttggcggatgaacccaccggtgcgttagacagtcactcgtcccagatgctgctctcgacgatccagagtatcaatgaagatctcggagccacgattctgatggtgacacacgatgctttctcggcaagctatgccaatcgtattctctttatgagggacggggcaatctttacggaaatccgtaaggggggtgattcccgcaggactttctttgaaaaaatcctggatgtccttaccatgatgggagggggcatgagcgatgtacgctaaacttattttcaaaaatgcaaagcggtctgtgaaggactatttgatttatattgtgaccatgacactctgtgtcaccctgttctatgcgtttttgtctatcagcagcacccattatcatccgaccattggtgcggaatataatatttccctgctggctggaggtatgaaactggcaatttgcgggattagtttgcttttgttgtttctgatccactatgtcaatcgtttcatgctgagaaaaaagcaaaaggagtttgccgttgaggcaaccttgggaatggagcaaaaaaccataggcctgctcttttttggagagacttttttcctgctcatattctctgtgtcggtgggaatccttctggggatggtcgtttctcaggtcattacggctatgctgcttgcttcttttggggaaccctacgctttttcttggtcgtttttcccggatactgtgctgttgaccgtgggcttctttgttgtttgccagattctggttggagtcgggaatgtcagaattctcaacaaaagcaggattattgagcttatgacggcaaaccgtcagaatgaaaaaccgcttcataaaagcagatggatgccgatgatctgtattttctatggcattctgctgctgtggatgctggaggtaggtactgtaaaatatcatttttacttcgattccagacatccgcttcctgtaaagctcatgtattgggggaatgtccttttccctgcactgacgctgctttgggcaatcgcaggtgctgttttacacagaaaaatagggttttcccgatatctttgcggacttctggctggtgctgtattgaccgctatcccgattttttccatcgcagaactggaaaaagcctacttccttggatttgacgctccaactctgaatcaatatttgctgtttggggttgcggatattttgtttatcatttccgcagtcatgtatttatcgaatgcggcgctcctatactggaaggagtctaaagtgtcccgcaaatatcataatacgagtttatttctgtttggacagctttcctctaagctggctaccaatacgaaaacgatgacgatcatttgtgtgaccctgactttttctatctgcttgtttgtcattgcgccggttttaacgggatggagtctgggctatttggacagtcgggctgtctatgatattcaaatttcaagccgctacaacgatgtttatgaagtggaaaatcttccggatacagactatggagaaattactgcgttcatagaacaaaacaaaatagcgataaaggacgatttgactttttcggaatatcttcccaagcaaagcgactttcaccagcgagtaaagtacaattttcctcccttggcgatcgcactgaaggattataacgctgttcggaaaatgttgggatatgaacctattatcttacaaacggatgaatttgctacccactggcatcgtgcagcagaggacaaggatattgaaaactacattgctgagcataccttattggaaactgacgcaggcaccctgaaactcagtgagaacgccgtgtttcaggagcctgtgggggaatccatctataatctttatacagatgtggtgtatatcatacctgacgaaatagcgcaagtcttgcttccggtacagcgcaaccgatttgtgatgacccaatatccgcttcccttcaaaacggcagaaatgctggaacagcttcttgggcgttcttatccagaagatcctgataaagacaatctggcaggatacagtacaactgtccatactacggaagtgaaccgtataatcgcccttaactttatcctaaaagcgtccttgatctatggtgcaattgttctgatggtgatgtgtcttaccgtgctggctcttcagcagctcctggatgcagaaaaaaacaactacagattttcggttctgcgaaaaatgggagtggaagagaaggacctgcatactttggttctaaaacagcttggtgtttggtttgggatgccgatcacagcggcaatcgttgtagcaattattgtgattggctattttcttcaaagtgtttctgctgaaatctcagcttatattggctgcggagccttgatggtacaagtagggattatcattggtattcttttcttactgctgatatgctacttcataagtacatggatattgtttaagcggtccatttcggagaactgataaagtcacagtacaaaaaggaaaagccgcctgtatgagcatttgatatgcccgcacaggcggcttgctttatctctggtaatcagtccaaaggtttatattctgtaacagttttcaggtatgtttccgggtcgccgttgagaactaaatctgcataggctgccggatcgttgtaaatcagccagtccagctctgaccgctgatatatattatcggcaacctcattctctaccgcaatcgtatcaatggcaatcatgctgccatttgcaaatttcagctccacacaggcagtatccatattgaactcacaagaaagtaaacgcttcattttgccctccttagatcatgccgaagtgcttgagcgcctccttgattgctttttccttatcgggcgggcattggggctgttttgcatcatcggacttcggtttgttgtaattttctcgctcgatgataccgcatttctgcttcacctgagcgatatacaagctgctgaccttgagtccggtatgctccagcacatattccttgatttccgaataggtggctttcttctctgcatcggtgagatcaagttcgtccatgtggatgtctacctcgatatgttgctttgcattaagtttggacaataaacataccgtctccataccaccagcctcgcgaatcatgtttgccatggccttcacaaggaaaccgccggaaccgcatgtggcgtccagaatgcaatcatccatgttcacttcgagaatcttgtacatgaagcccgtgatgtgttccggcgtgaatatctgtcctgactcagacttcttcttgtaacggttgaactcgttaaagaagatgcccatcacgtcctcgccgcgccactcgttcgagttgacgcactcggaaatctcgacgacccagtcgatgaagtcgttgattgccttctggttgtcggtcgagttcatcttgatgtcggaatattcctccagcaggatgtcaatcttcgcattctgcttacggctggcaatcaatgattttgccagcgtcgagtggatcgccgtatggaacgtctcataaccaaggtctttcagacgctttaatcctgcaccatatcgctctgcaaccaacgcacatgctgtgaaaatcatacggtgatacagattcttgatgccgaactcgaaatgcaggcagttgttaatacgcgctgtcagctggtagatgcgctccttgtcgatgttatcgacgatatagagcgacaggtaataaccgacatgctgcaacttgtcgggcgtcttgacttcctcctcgcccttgaacacgcgcacgtcctcgccgttgtacagaacaccgacaaccttctcgtactgcgtttgtacaatgcggacattcttcagcacctcgtccacctgcgccttgccaagggcaatgcgcgtcgccttcgtctccaacaccagcgctacatctgccttgttcttcggcagatgccagccgtccggcttgtccgccacacccgcgaatcccagctgattgaacgtcgtaagctgaccgacacccgcacgcgctgcgtcgctgtcggccagtccgaggatattacgtgccaaatcgcgtaccgcatcctctgttaaattctttgccacttactcatccacctccttcagatgctcttgcacccactcgtggatgattgcggcaatcgtcgtctcgcgctcggccgccatcatcttgagcgtcttcttgtcgctcacggtgagcgacagcgagagggtcgtgcgcttctcttcagccgtcgtatcggcgacaacggcctcctctatcttcttctgctcggcctcgcggtcggcagcgtatttctcgaacatgtccgccatggctcgaccttctttaatcatttacacatttgtacaattatacatcatagaggcgcatttgtccatacgtaacacgtctctgaactgcggttattccttcgggaatcccgcaacctcgcgcaccgtgtccaccagcacccgcgtcgccttcgcagccttgccgcgtcggtcgaactcgaccacggacctgccggcggctcccgcctgaacgaacgcctcggactggggcagcgtggccaccgtctggtcgcctgccagaccctcgaaccactgcatgaagtcgcgggacgccttgaagcggttccacccgttcatcacgtagacaatcttcgcgtggctgttcttgaacaccgccttgcgcatgcgcatcagcggctcgatgtccctcgacgtggttctggtcaggatgaccaccacgtccgcctccttcagccagtccgacagcgcctcctgcaaggcccccggcgtgtccaccacggcaacctgcgcggcgtccgcctcatgcgtcttgtgcaacgtgccgccctgcgtgtccaagtcgtagaagctcacggggatgccggagcgctcgaaggagaaggtaatctcatcggcgaccaaggacttgccaacgccgcccttctgattgcataccaggatcgtcttcatatcctcacctcgctatgtatttaatcaattatgtatttccatatttaattatatgagccgacagatgcgtgttcaaccgccactttcggggctttctctgggcttttgctggtctccaaacgggcttcacgccctcgcttcgctccgcccgttccgccacgttttccgaatccgtctcataaacgagcgggcggcgaaaaccccgatttcccgcccatgcgtgcttccagtttctttggaatgttgatttgttttccgtcgatcacggtatagatgcttatgcgatgccgatatatttgccatcgcataagcaaacagatctttgtatcatctctatccctccctcgaggaagtttatacagcgattatacagcatttgtcgcgtggaaacaaatatgcttgttagaaaatgcctatggattactcggcagcattattttttgattttcggacgaacatatgatattataatcatataaagtctctctacgccgctcgatgtggcatgtatctttttctgcttatgcagactgtatctataatggtttcaggtttgtccctgatataatttcgggacaaaccgcaaggtctgccccgtttttatataaatttttatgaaagcgaggttttcaaaatgaaaaagatgaatgaaagagggtgtctgcgtgagtagcactgtcgacttagatcttgagcgcaagcacgcagaagatttggagcgcctgcgcggttttcgtctgctggatgatgattttatgaataaggtgtttgaggacatcgcctgtgccgagttcttgctcaagatcattttgcagcgcaacgatttacgtgtaaagcaagcacacggacagcacgatattaagaatttgcagggacgctctgtacgtcttgatattctggctgtcgatgaagagaatcacgtttacaatatcgaggtacagcgcaatgataaaggtgctggtgcgaaacgcgctcggtataacagcagtctgattgacgccaacgtgaccgaacctggtgataaatatgagaagctgaacgaaacctatgtcatttttatcacggaaaatgatgtgttaggtggcggtcagccgatctatcacattgatcggacgatcaaagaaaccggcgcattgtttggggacgaatcgcatattctatatgtgaattcccaaatcaaagacaatacggttctggggcggcttatgcatgacttttcctgcactaaggccgatgacatgttctatccaatgttggcgaaaaaagttcgctatttcaaagaagatgtgaaaggagttgcaattatgtgtaagattatggaagatatgagaaatgaagcggcgcgtgaagcagccaaactcaactcgattgagaccgctcgtgagttgcttgcaatggatataatgtcctatgaagcaatcgctaaggctgttcgactcctgacagttgatgaagtcaaggctctggacgaaagaaaaactgtctaaacatcgactcaaggaataattgaaacaaggtgcagtcaatttgactgcaccttgttcatttttattgtatttgtatagcattccacttgtggaagctatttgtaagactaaattccacccccaactggaatttacttttacaaatagctttcgcaggctgacaaaggttgccgcccttgtcagttgccttttcttatgctataatgatatatacataataatgccatccatgtttacgaaaacgtcctcgaaactagccaatcggggacgtttccatttcagtccatagttttgaggcacgggatttctcatataagtggccgtaatttgagagtaatgattcttttgatgtcggtacacactgttccctgtttgcgccgtggttccccgaactttcatacaaacttagctcatgcgtgcaaggggaatgtgccgataccccagtttaaccgtatttccgtagaggtctattctattcgagttaatcgaaatatctgctcagtccggatgtgataaataaggcgaataccaaagatataaatccaacatataattgcttaaagagatgagggatgaatatgagcaaacgagtatatattagcgctgattacgacccattacatggggatcagaatgtcgttaatgaattagttagatggggcgctgatagtctacataaagttgattttatcgatatggcagatgtgaaagatggtgtgtccggcggagatgattgtcgcatttgtgatctgaaagctgaatttaaccgtcggatcaatgcatcatcggcggctatctttattgtgggtaacatgacgcaatatcgtgaagccggcagtttatgtgaacgttatcataaagcgcaatatctatgcagttgcactccatataaaaagaacgcatctggctccagggcatgtaaaatatataatgtaaattattatccttgcgactggcaatataatggtttgtgcatcataaatgattattcttacctgcgccacgagtttgaacaagctaggatgaaaggaaaagatttcatcattttatataattccacacgttacgaaacaagttggctgccttactatatgcatgattaccgggctatcgcaagaccattttggaaaatcaacgcatacggaaggtatgtcggagactattcttatataaaaggagccttgggattttgaaaaattacattgtaaaatgcagccaacatgcgttttcaatcattaccatcattttcgcttttgtaccagagacatggttttctttaatatcagcagtgatattgggatatacgccatgggcgacggaatactcttcttatacatacatcataatttctcgtgtattatgttttatattagtgttaatcggggtgtctgtttatctaaaaatccggtctaaaattactatcaaaggagataattattatatttgtgttgagtatggggatatattccagactgatgactgcaaatgtgtaatcacctttgatgaatgtttcacaacgaaaataggcagtgctccggcagatatcaactccgattcgatatgtgggaagtatttgcgcttacatccagatttaaacgatgagactatgacctctttaattgaaagcgcacaagttcatcctgagcagactccctcaaaatacaaatcttctgtgaggtatgagtctgggaccatagttcccgatggcaatgatttattgatggcattcactccattagatgaaaatggtaagggtaggttcccgtcacgggatgcatatcttgcatgcttggataaactctggaaaaatattgagaaccattattctgaaatggacgtatgcattccggtattaggctctggaacgactgtgtttgatggcggttcaggagcatctattccccagcaagatttattggatctgataatatggtcatatcgattaagttctcacaagataaaagctcctcacaaattacgtattatctgtcaacgaaaagataacttttctttgaatcatatcggtgaatcgtaatttgttctttttaggtataaacaagaaaagcggtgcagttcaatagtgaacttgcaccgcttttcgtcgacatatcattatgttttaattcaggcacctgttggatatcaatagctgttgaaggctcgaatactgccacattaccagtattaacaagcatctgctgtctgggagcgaaatcgtattctaccagttcaccgtcccaattaaatcaaagtcaactcgcatttttagcataaaacctaaaatgcttaaatgatgataagcatatctgtcaaaccttgcgataagcggtgattttcttccagttttctgggaatcccataagctcgagtaattcatcttctgtaatctgctgatttgctgttacagctttctgaatcatctgatttaagctacgcttgtattcggtaaattctttgtttggaagtagatatcgaaaagccaatagaactgcaaaaaagtcacgttttccatagatatactgagttccttgcataggaatgttcattttcttatgtaaaggaaggttgggaatttcgtgttgagcacaacgaaacgaaaataaacgttcgttgtgagcacatacgtttcgaaagtcggttaatacttgtaaaatttgtcgtagttgtctttcgttaattccatcaaactctttgctgatggaaaactgaatatcaggggtcgaatactgatacatttttgaaagcgtaccaaaagtcagagcattgattaaaacccacaaagggacattttgatgctggttcttgtagtgctctatatactggtgctcagttgatctggctattagcggttttaaataacgtgtaatgagtttattgacttgagatgcattattttgaggatacaggtcatagttgttaggattaaggtacgcggcttggtgatccccgtatttctgacaaaatgcatagctcaaagcagagcgtatgtgccgttcaacatgcaaaagatgacttagtgtcatttctcgtaaatgagcatcaaattcataaagtgcaacaatgtcattaaatgtggcaccatctctataatcctttgtcgtaggatttttaaatagatttttatatccggtgataagtgcaaaatagccattcaatcgaagtgtttctatcgcttcgctttcgttaggaacaagcaaattcttatccctcaatttctgaatttgctgttcataagtcataaatggtttttgcactcagatcacctctaaatctctatataaaaagggagcccccgcagggactcccccggtcacaggccccgcgagcatctgtaacctaatcactgtgattagtgtaccccttttcgctaaaactgtcaactgaaagttttaacaaaaagtttttagctaatccagcaattttattatacagaaaacacttatgattatttgtcgaaataaatgccagaaatgatatttttttctcgtccgatttttttataatcttatatactaaatatattgaaagtcagtaatatcttatccaccgtatcaaatccattataaaaataagaaccactctgatttatcagagtgttctcctgcaatatggtaattaacgaagtcgaatttttctttatttgcttcgtaataccccattgcacatttatagagaacaagacacagccttcgcacgctcaacttatagatacgagttggcctatcaccaggataactgtatataagatatttgcaatcactataaatatcgaattcctttttggggtcaagtttcaacacaaaatagttgatttgattgattttgtttttgattttcctttgatcgatgtttggtgtgccttgatggagaagaaaatttcttagattatatacaacttcaccacttagatatggcacttcttcgctattattcttagtgaggggcttttcatattgcccaacgtatttatcataccagtcgatatagcgtttacgtgtggaatttttctcattaggatattctgctttcccacaaatatccggaagagtaagagataatgcgagtgctgcaaatagacagtctgcatctaatgctttaggaatatcagaaattattcgctctatcattacttatggttccttctttcgctgctatcaaagaatataattacagtattgaggaaaaacagcgcagtgtacaatttttgaggtacactgcgccgcttaaaatcactttttacttgaagacataaaggggcggatggactctgctacgttcgagataggcatagtctgaagccagatccggcccggccccgtcagggtggtgttaaacaggccctctccgccgagcagcttattcttcagcccgggtacctgctggatatcaatagataccgaggactcgaatgctgctacattaccggtattaacaatcatctgctgtctgggtgcaagatcgtattctaccagctcaccgtcgatttctaagaaagccatgcctgaacccgaaagccgctgcatgataaagccttcgccgccgaagaaaccagctcccaacttcctgttgaaatggatggacagctcaactccgatctccgaagcaaggaatgccctcttctggacaatcaggcccatattgggagttatttggaccggaaggatctgtcccgggaagcacgagccgaaagcaatcagaccgtttccttgtgccgtgtagatgttatgaaacatatcctcacccgaaaaggctttactgaacatctttcctataccaccacccgaggtttccatcttcatattcggcgacatccaggccataccaccattctcggtaatcatcttctctccgttttccatgctgcaaattacaaccggaaagactccgcctttgatctcatattgcatctttttctctctccttttcttcttttgtatttctcaaactgccttaagaggcagccttttttaccaaccaggcatttggcagatagcggccgtttgccatcggactactcgtatgagtaatcatctcacccatgtaggtcatcgaggaactcgaaccaccgtccatgttcatcgcattccagcagtcatagcgcagcagaatctcggcacactcggaaaccgttgtgccaaggctggaagcctgcctcccgtcaataataagcataagcgtggttttatccgctgtttgtccaatcgccgtccttggctgaatacccatgccgtacgagccatcagtatggttttcgccattcaatacaataatcggatagaactgtgcagcgtctctcagttctgatacatcgagatcgtatcccatacgcaggttatcgtcattatcgtaaccaataatctggtactggccagtaaccgccgaattaaccatttgcccttctgactttacaaggccaaccggaatgttacccattcccctgccattgaagtcttgaaaaccacccgcgttaatgccaagcacagcattgttggcgtcacactgctccgtgacagtttgtcctctgttcgaaagtgtattatgtgacaggaacacctgtgagctgtcttttacaatggccagcttaccgcgatagccttctccagatatatttacaataagcagcttattgggcgcatcaatagcccaaatggtatcaccggcacacgtttttatgcccttgtcggcaatatctttgatctgtaagctcattaagctgtcacgatcaatatcttctggaaacgttgccatatcaatctcagggaacaactctgtaaattgagtataaacgcctttcgtcagcggctcaatcggagtcgaacttctggttggcagtttgctctctgcaaccatgttctcttcgatctgtcgctgcacattctccattacctcgttgatcacgctttccgggaagaaagcagttgcgagccattggtggcgcattgtgctcatagctgtttcgatatacatggtccgcaggttcgcgatagccgggatggacgtgtatacaaaaaacaggtacatgccgactaaaacggcaaatatacctgctgcaataccaactcgtttgaaaatcggcgtccgaactctaaaatctggcaagccatcgtcctcaaaatcaaactgttctgtcagataatcaaaatccatgtttgatgatttgatttcgtctgtttgattttttagtagattcacaaacaaccctcctagttatatatcttttcgcatgcggcctctttttagattgacaaactgactcagtttgatgtccgagagacactcagtttgaagcgaactcttttcgaaaggactaaaaatgaagcgagtatcaaaaaaagcaccatctccccgtctccgtatcaaatttttgcacagcataaattcgagcattcgtttgtgagcttccatgtcatttccgtttatgtagaagcagcacacaccttttcctgcgtcagacatttttgccgcagctgcagcaccttgggcaatagcctctcggcatacatggcgagcgaatgaactatccgtaaaatgatactcccatttgccacaggtcgcaccaagtgtgttcgttttatctccggtgaagaagttccagcccgactgtttgcactcgcgtacggctgatttcacgtcattctcgtgctgcttttctcgctgatagttcataatagaagcgataaatagtgcgaccatcgctattaacgaaataattgtgcagatatgaaaaatagaagttatgtatggtatcattgtatagcctccctagtgttaagcgtctgccacaggcgtattgctataggcttctccgcaatacgaaggattatggtgtccgcctatagcaacaatttctttgtcggttttcagtattgttcggcttccttagccggtatccgaccagcagacatcaacatgtagccactaaaaaagaactcacggaaacaattttcagaaaacactgaaagttgctttcgtcaattctttatgatttatataaaagcggtggatcattgtaatccaccgcttctgtgtacttattgcagtcgtacatgatgcttcagctggaagttttcgtcgttcgagcaaagatagataataccttcgatcaaacccacgatagccgggatacccgtccagcagaagagcaggtaaagaacacccataccgatcttgccaagatagaacttgtgaatgcccagactgcccagcaggattgccaggacgcctgctgcaaccttgctcttgacaagccacgacgggttaatgcccgttacatatacctgctgaggagccgcctgttgaatgataacctgtggctgaggctgtgcctgctggaacgactgcgcagcctgttgtgtggcgatcttttctccacagaatttgcattcagttgcacccggatcaagaggtgcaccgcattgtggacacttgttttcagtcatgattttacctcctgttacttacggcccatgacgtacattggaatagaaaccaatgcatatagaatcagtagacctctgtttatgagcacgaaaaagacgtgcggaatagacgcgacaagcgcgacattcacaacattaactgcaacggtatataaaacagttgctatgatcagtgggacaagataccctgttttcatcgatcttgacacgatattgcaaaaaatgaaatatgccagaaaaacaaagccaatgacctgatagattattgacgagaagtagttcaccagcatatctacgtgcatcacgccgatggaaacatacaagattgtagaaacgtaaaaaacgaaaaggattgccgataaggcgatagttatttcacgctttttcatggcgaaaccttctttccgcactgaggacaaaactttgtaccaggaaccaacttatatccgcactcgcagaagtgctctcgattatcagctccacattcaggacagaatctgcagttaaccgctattgttgcgccacaagaaacacaggtttttgtagatggcgttgcttgagctggtggttgcacgacttgatttatcgtcgaaccaaggttagctgccattccaacacccatgccgcctgccgcaaaagcgcctgcaacaccgttcgggttctgcgctgcgctctcgtaaatatccattgaccgctgggtcatatatcgctggtttcccatgatctcaaaagcagctttgttttcgaggatcttgttgattttctcaaagtcttcgtccggaaaattgattgactgaatgtagaaatttacgatggtcaatccccattgttcaaatgcgggcaatatttgttgccgtacataatcagagagtttttctaactgcgtggaaatttccaacgcagaagtaccgttcgtaatgattgcatcagcaatggccgatttcgctttgatggcgatgatgccgcgaaaatattccttaatcttgtccatctttacgacatcagcttgttgcataccaccaatcaaacccttgaagaaagtagtcgggttagaaagctgcaaacccatttgtccaaaagcacgaacgcgcagcttaacgtaatatttcgggtcaaccaactgaattggatcaatcgtaccccagtttacgtccaaacgcgtagtcgtgttaataaagtacacttctgcactgaacggcgtgcgtccgccaaatggcagattaacaaacgtccttaaaatcggcagattttctgtagccaacgtgtaggcaccgggataaaacatatctgcgactataccgtttcgaacaaacagtgcaatctggccttcctgcactatcagttgggtacccataaccagctggtccgaaggatatttgtagataaaccaatctcggttacgcaggccatcgaagcgaactacatcaataattgccatgattgttccccctttacgagatggcgaataaatggaaaaggcggaccaaaaacgatccgccttttcgtattattacattagtgtttttttccgctgccagtgaagtcgtcttgatacatgttgccatttacatatacagacttagaagcagtgatagttgccgactcgtgtgtgtaccattccttcagcgggaagatagtatagtgatgataccatctaccagttttgctgctgtgtccaccacagtgagttctctcagtggtagtagtccagtaatagtggtcaaacgaaaccgtggccttgcaggttacggtccagttggtcttattcttccagttgatcggaatgtaggcctttgcatacctttttgggctaccgctattgttcggcaggcggaagacccatacagtcgaagtgctgcgagagtccttgatcatatttaccgtgactttcttaccgttcttattggcatttgtcagcggcaggccttccttccatgttgctgtagccgttactgcgatgttcttgtaagtgttcacggtcttactcttgttggctgggctgcaaccaccgttgacagtccatctcgggtaagacttggcattaacatacttcgatacatctacataaaacagaccgtatgcaccatagccagacttagagctcgtcagcgcagttctgtattcgtccttaaagagttttacagaacctgtagctagcggcttgttgttgttttttacgtaataaacgcgaataacgccgctcttgtctacaactgtaagcggagtgcctgagatcttgtccagccagtaaccatcatagcccttcagcggaggatttttgatagttgtaccgatatcagcatcataggtggccgattctttcagcttaccatcaagataatactctaccttgtatgcgcccatcggagccgtaacatcgataataatgatgttcttagcagggtctcttaccaatgtcagaggagtgttctctaccttgttaatagtatagccgggcggaacaatagacttgtctacatcggactccttaacgacctgatctacaacgcccggataggtcttggtgtacttctcgttgatagtgccgttgatacgcagcttaacgctgtacttagtcggaccgtatgccttgtagtacaggtttacaacagcggaacgcattttgctgtttacaacaacagtagcattcttgtaattgtcgccagttacaaacattgcgctgccgtaacccagagctgccagagcatcgtaaccgtagccgcagtcaaacatatagccgctgattgccttcggaccaaccttcttggcgccaaaatacggtgaagtagcactgttcttcatcaggccagtaccctctccgttaatcatattctcacgctgagtaatgatttcacggatttccgcaaccttcgaattcgggttttctaccagcttgttggtcttcttatcgaatacccatgtagcagcagccttcttgaagtcagatgcatataccagattggtatcggtcagggggatgccgcaattcttcagcgcagcctgataagccggcgagtatgcggcagcaacggagctgacgtactcagcgaaagcatcctgagagttatcgaaatccttaaactcatcagtagtgatggtcgtcggagccgagatctgtgcaccagtgtcaatgtcgtaatagtttacagaaataccgcccgtctgcttcagcgggatcacaatagactgcttacgatagtcgataaagtctcgataacgactctgttctgcccaatccgcataggagttaatgcctgtcgtctggctcggcttgtaatacgccatattatagcgctgtgtcgaacctaagccctggcattcaacatacgccgggccttccagtttgatagaaccggtagtacgatccagctttgccttgtttgacgtcatatagtttttcgctataaacgcataagcattggctagcgactccgacgtgatgccatatcctgcttccaggccatcactggcgtactcaatatcgaagtagcagtttccgtactgcttaccatccattgcagtatacagtgcagtaccaccgctggtcataatgcccttagtgttcttgacatactcggtctgagatgcagtataatcatatgggccaaacggcacgccatcgatatcataaacctgcataccaactcgatgatagcccacactattttgcttcttatgagtgatctgaacggtaaccgtcaacattttagtgtcgataacacgtttcaggtctttatcataaagctgagcttgaatgtagtagacaactgcatccttcatgttttggtttatggtgatgcgagcttctgctttaccattgcctttcgcagcgataggtgcgtcaactaggtaatcttttgaggtgtcatacttcaagcgaacttcatagtcattgctaatgccgccttgctcatttttgcaaaaacccataagctgaatatctttagccgattcagcaggaataagctgctcagagccagttgttcgcattatccatgtgaaaaagctggcatactgccaaccctgagggctattgtttcccagcgtaggtcttgcacaaaggaacagattggcgatatccttctttgtgtttgtcggcgtagagtcatctgcatctgtcgcgtcatccgccttagatgttacgctgctggacgtagaggagtccacatccaccttagatgtcacggtactggatgtagccatgtcaatttgcgattcatttgccgcaaacgcagaaggataaaaagagagcgccattgcgaagagcaaaaatgcgctcactaaacgcttcttaatattatgcattgatttgcctccatttctccataagaaaagcgacaggtaaaatacctgtcgctttaacttttattttgaggaaaatgaaattaccacttcgtaagttcccatgccttgatatcgttagcgatacttccggtgtaggaagagaacttatacttgtttccgatggagatgctggcgcgtacttcattatagtgatcttcatcattcagctcataaatagcaagtcggaaggagtggtcaccatatccgcatttgaagccacgactatcaatccaacgtagagcggaaggatattcattggtctcccaaatttcctgcataaatgcagatttaaatgcattgatggcctcatccggatgattcggatatgcaatctgcagaatctgtttggccagcatgcgagagtcatagctaaatccgctggacaaaagcattttgccattggaatcgtacatatcctttacggtactaccgtcaacagccttgaaactattgggatcatttccccatgcagccgaattccattctttcatgtcgatatacagaagattgccgacctgagttacagtgagaccaccatacttcgggtcttttgctgtcagctgtttaccaccatgaacagaatctgtaccctcggtccagaggccaagcgccttgatttcatcataaattacggcattagtttcaccttcgccaatctcggcaacatctgccgccttagtccagccggcacgaacaaacatcgtagcggcctgagcgcggctcagcgctgccttcggattgaaggtgcccttggcgtcattgccgatgcaaacgccctcctgatatgcgcgaaggatggtatcagcataggtataagtgatgtttgcaaagtccgggatgttcgcagcggtcagcagcggcttctgggtcagctctgcatccggaccggcgccgaggcccttctccagcatgtagaaagccagctcgcgcgagcagttcttatcatagttctggggagtgatcgcaccgaggttcggcagacactgcagatcgttgatgcagtaatcaacaacaccataagcccaatacttagtattgtttgcactcttgcccgcatagccctttgcagaacaaatcagctttgccatctggccaatcgtgagcttgtcttcggggccatacttaccgttgccgtagcccttaataagaccgccttcggacatcttgttgatgtaagaggtagcccagtggttggacggcacgtcgctgaacttgctcgttgcaggggcagcgaacatgcctccgacaatagacacagcaaccgtagcggaaagcagagttgcgatcagtttgttacgcttcttgccaaatttcatacgtttttcattcctttcttaaagggatatataaatatagggtagcaaatatatcctgtcttgatgtgattattatatcactgattgatttagattgcaacccttatattttgaaatttaatgtggaaccaatccgaggaaacccatcactgctccatcaatcagcgatcttttccattttaccatgtgtgatcccccccttctttatttcagggtcgagcgggatatttaagagtgaactcccgctcggtgttaattaagctgcactcatcagcttttctcgttttaaaaatgttctgaactgctcaatcggagacgttgttatatcatagctggtgacagcaccggtgttaggattgatgttcaaagaaagtgtcttagaagtagctgccttataggtaagatagccaccagaggtttttgcataagttttatccacaacggttctgtcatatgaaatatcgcccttcaaattcgtacagttgcggaacatacgactgctgtcagtaaccttatctgtattccatttatcggatgcgtatatcgttgacaggctgctgcaatactcaaacatattactcatattagtgacattcaccgtagaaaaagaggagatgtcaaggctcgttactgatttagaaaagctgaacatggatgtcatatctgtgaccttagaagtatcaaaattcgataaatcaaaggatgttagtccgcaactcgagaacatatatgacatgtttgttacttttgatgtattaaaatttgaaagaaccaattttgttagtccacatgcttcagtaaacataccactcatagtctggacatttgaagtatcaaaggtagacaagtccaaactcgttaatgaggagcagttcgcaaacatcatgttcattcgagtaacttttgaggtgtcaaaattagagacgtccaagtttgtaagattttcgcaatcagaaaacatgtcagacatacttgttacattagacgtatcaagaaaagaaacatctaaagaggttcctttaaatccgccaaacatccaatccatattctccgcatttgtcgtattaaaacctgacaaattcaagtttgtcaaaccacagacgcgaaaaataccatcaaaatttttcacgttagacgtatcaaaatttgatacgtccaaatttttaatattgctacaaccgaaaaacatatcagacatattctctacttctgaagtatcaagtaacggtaaattaactatttctttgagaccgcgaaatcttgatagaacactcgtataggaaaataggtatgatgagtcagtgttggcttttatgctacccgacccatttccagccataataagttctgtaccggtgcgatagcatgcaatagctcctgtgccatctgcatcagcagcccatttttcatcaacattatccgatggagtataactatccatcagcgtgatttttgtaattttattacgcgcttctgtagatttgtaccatgtataatttggagccaataccggcccggaggatgattttacaacgaataccgctattgcagcagtggtttctggttccgatgccaatgttctcggtatttgagcgtcataggaaatatccaaagtatcactcgcagcaatgttgctaaaggtggatgtatccacgacgcctgaagaatccatccaagcaccgttaaaacccatagaaatgagtttatctcctatcgatgtggaaatgccctcatcctttgatgtaagcgtccatccattttgcgccgtgacattgattgatgataccataataggagaactgccatagttatgaatagtagcattggtcgcggtgaaaaccgtgccgtctgaagataccgtaatcggcagcgatgccggtacagttgcatcaatgtttgcagcatacgcgctgcaacataacactgccaacgaaaatacgtttattgtcaagattctcaatatgccaagagataggctcggccgagattgttttacgaagaggcggtaattatttccctgttttcgggacttcctgaaaccgaacatcttcacttttctcctctcgtagaatacctttttatcgtctgtggaaaagaagtttctccagcgaccccaataagcacaagacgattgcataggcagcccatagcaggacgcaggcaataatgcccaccaatccaatgcccagtcctgttaccacagtcagggcatcatggacaagtccaacttggtttggaaagaagtctcctgcgattgagagtccccatagacaagagaccaccattattcctgctgatagaagaatcataaggatcatatcccatgtatacttctttcgaatcttgggtttgggcttttcggtttgctcaggggttgtgttaatgatattttgctgcataaggtcacctctcaaggcttcagcattgcaaagatctcattcagcggcggaataactccaaaatgtgtcagcaacgagatcactacgcctacaagaacgattgtcagtgcaacatgaatactcagtttgagaaagcgataaaccgaagccgcaaccatcaggcaaaaccccaagctccagtcgttgaccaacagcagatggcccaggtgagtaagcattgactttattgcctcaaaatcaatagaaataggcacctttatgctctcccctttccgttaaaattggttatactggccaagagcctgattaagctcggcttcttctttgttatctgcatcggcgaaactgtcagcatcatcaaagccggccggcatggaggtatcttcctcattggacaaggcatcggctaccggctcaaaaacagcgtcagactgaacaggggcgccttcattctcaggggctgctgcctcagccggaatttccgcacttaccgtctcttcagcactggcttcatcatcagccttctttctgcgacgacgcttgccggggattacggcgccctccagaagagcctgctctgcctcagacagctcaatatcccatttctcagtcttctgcatgatatccttaatcacgcgattacgtcgagtctggagaatacggataatcgccgcaacatcctttgcatcgtccttaacctcggacgggttgagtgcaacgcgaatagcgctgtgcgcagtctcgccattaccaaacgccagagtgactggtgcatcccagttgtctacctgtgcaaagtatgcaagtgacttcagttctcccagcgccttagaaacctcattcagagctttctgctgcgcttcattattgcgaatagagggcattattatttctccttttccgtgatttttccttctgcacatcgtttacaggggcgatacccttgttgttcggctatatataatgcaacagctcttgctccttgcagaccagagcaagtcggattaagatgatatatcttatagccgtccggtataaggtatactattggttctgagcttggctccacataaagatcgacgacacaaccgtacgaggtttcatcgtctttgcgctgtttcagaatttttgatacttttgcgattggccgctgtgtaccatcatgagtatccaactgttcgatatcttttttggacactgtaccaataatacctagtgcatgtcttaagaaatagcatggcaggtctctgccgtccttcttgaaacttcccttttcgatttcaagaggatcacccggcttaacgtatgtaagcaatgtctgccggcttgttttcccattataatgatgaacgcctcgaaccaatacatcggatacatggtctgtcttctcaacaggaggctccgctttcttggtctgtgggaatggggcaagtcgtttagccgtcatatcaaacatatattcgttgatgtgtccagctgtacatgtcgtctgcatgaccaactttgcatcctctttgccgaaaatctccacatggtcgattaggcaagagcaattgggctcaatgcacttcataaaactatcaagcttttttccttcaatcttcactctttgacaccaccttcgtaaaaacaagcgctactctgacaaaagagtagcgcttgtgcttcttattcagctttcagtatttcagcaggctggtaatcctgctccattgtaaacttgatatgcttagcatcggggtgagccgcgaagaagaacttgtttgcgataacactttcttctggtccaaacaggattatgcacttgtcacccaaattcatacggcagatctcatccggcgtcaatgcttttcggcttaccggctttttatcagagagattgacgagacccttctctgtgcgatgctggaaatactgtaccgtatccatatcacacaagcccatcgacacgacggccgcgcaatgatccaaaatgctcaggtaagactttggatagagcatagagaactgagggatattgttcaggatcatgtgaaccgaaatctccttctctgcgccggcctccagcagattttcgaggtgttggatagaacctatattggcaaactcatcgaacaagaaattcacgggaactctgcattttccatcaggctgagtttctgcgaacttgaacagtctccggaatgcttcatgatagaacgtcgagcttgcaaagcgcatgtcagactgaaaatcctcaaatgaaataaagtacgcacacggtactttggccggaagttccagatcaatactttgaccgttcataatctcacataccgaatttttcatcagcgccccgagcttcttggacagcagttcgtatactgtgtcctgcgtctcgcttggggattcttcgaaaatcatgtaagcattttcgcattccttggagctgatgctcttcatgcgataacccagatcgccttctctgtatgcaccgagaagcgcgtacagggcggccattttcgattttgtcaggtgtttctgcttcgacagaatatcgacatagatcatcagggcactaagcagcgatgttgcggccgctagaattacattatctccactcggcccgataatgtcagttgcgatctcgaaagccttttcggggttttctgctacaccttcgagcatatcccaatgatccgaattgccatatcggaaattcagtctccggataacataaccatgttccttgaacgaggtcgccagatccgaataaagtgcttgcgcattatcgttaataataacgctttcgttgcgacgtatagcctgtagacagagcggctttgcgtagcagacggtctttccgcttccgctgctgccaaacacacagacgttctttccacgcgtttcattgttaacgataacacccttcggggtttgtccaaggatcactcccttgctatcagaaacgtcctgaataatatagcccttttctttttcgtccttaaacattgatattcctttctgcgtgagaatcacttacgcaaggtagtctccaaaatctgtttggtttgatctgcgttcagtgatttatgcttgcgcttattgtgaactgtctgctgtatgcaaatgagaacgaaaacagcgccgaagcatataatgatgattttcaacggcgatggagtgactcgcataattctttttgcggttttagagaatacatcgcttacatacttttctctattgcgatccgaatagtagagcgcagagaaatagttcttcagaatttcgcatgcttcatcgtccatgcatttttctgcgtctgttccttttctgatgtaaacagcgtagtcaccatgctcgcgctcaagaaagacaacaacaatgtggccctgatcagggatactctcctcgttatataccgtattcaaatatgcgtttacttcatcagatgtaggcttgggatttccgttgatgttgttggtcaggatcagcatcggatatacgccggttttcgcataaaaagaacttattcccttttcagcctgctcgtgattcttgatccagtccagctcatcaacaataaagtctgttttctgaatggagttgatatgcaccggctctcttttgactgttgatttctcaaccgtgctggtcggcagcaaactgtcaacatctcctgaagaagctactatgcaagaaaggacggccaatgcgataatgaagaaggccagcaaacctgctcgccatttacgctggttttcctccagagaaaaatggttttccttctccagactcgatgcgggcgcttcaaactcactcatctggggttgtggaacttcatcctcgttggcgggttcagagttttccttattcaaattcatacctttgcctcctttcacgatatattctctctactcgatagaagtgtattgcagaagatctcttccgcgtatagcttcttgaggatagtctgtgtatccaaggccgaatatgcagcagttgtgaactcctgttgtaaagtatctgcctgcgcaatgcactcggcccgcttagcttgaaatactagagcactgtccttgcggccgttttgaagagcatttttcgccagagcttcgtacttgcgaatatttgagatattcatctctgccattcgctttgctgtacgttcggttaatttcgctttcctgaaggtgctgttaaccgtatagcagagctcatctatacgcgcggagaattcctctaattgttggacaaatacttcttcaggggtatctgtgtcatcgcagaggaccttgtgcatatctgttatgattgcacttagattggaaaatgaatcctcgttttttcttgcaaactccaattcaaaatcctcgaacagcttcgagatcttttccacttaatcacccacaattatcagttttgagagaaaccttagaacatcgccggatcaaactcagcagacttcttactctgctgctcctgcatgtagaaatcatcatccagaaagccacgggaatatcccggagggcacggcgttttgcgcttcatcgaggcacgaggattaaaaaggccttttgcgaggccttcttcgtactccgacggagtgaagaagcggctctccctgtatacagcaccgctgccctttctgaaatgaaattccagctcataaaaacggcccattgggtgaatataacacactctggccggaacggcgacagatttgctgctactttcaggaacagcgctaataatatcatttagtttaaacattgtgcacatcctcactttttctttttctttatctgttcttcgggaatgtttcctacttatattgatacttcgaaaaaagctgatttgccaaacgctccatgccgctgaccagcttattgaacagaacgaccgctttgtcccagagaacttttaaatgcgctccgttctgtgtgccgatatcccataaagcaaaaagtatgaataccgtgaaaaacaaacctaaaacaattgttcggccccagttatactgagcaccagcattatgccaataatgccggccttctcgatagtccggttccgcaggagaacttggttcgataggctctattggctgttgttcttctttatcgtacatggattagtcaccggctctctcgttgtctgttctgaagttatccgacttgtatgtattgctccattcgtatccattgataccaaagtatttacacaagcctgctttcatctgaacatttactgtaacctgcatataagcgaaatcaccttggttcttctgctcattgtcggctactcggcctctaaagaactccggagtgccgtaagatacatggtaaatgagttttccagagtcagaatagcaattccctgaagagtctactttcaggtcttcatccatatactctttccaaagtgattttgccttgtctacatccataatattgtagccatcagcacgccatgtatcatcgatgcaggtttcaacaatgctgttgacggaccgctgcgctcgaactcctatggcatattggacgtcaaacatctcttggagttccaaaaagaacaagccgaagagcaggattactccagcgataccaattaccgttattgttgaagcgcctttgcgcgggtttttcaaaagttcatgcatagtgtatgtgattcacctacttatctccgaaatggactggatcggggcgattttctgtgtcaaagaagaactcttctctgaattccttccgccaaactgaagacttcctgcgaaatataatataactcatatcatattccattgctcgtcttaggtcttccagtaaatttcggattgtccatttaccttaactcggatcgggatagaccacggatccatcgggtcaccaaatcccggattgatcagagtaacgtgatagtttgccgaaacatttactgtgaactggtctctcaactgaattgtagcttccgatacatctacccagtcatccgcagaaacagtaactcttgcatcaatatcatcggcattagggagcagttcgtaaagcagcctatcaatctctgtttgcttggcttcacccgatacctcgaccgctcgagcaatacgctgtgcagcatatgatacttggttcatctgcaaagcatagcctatgataagcagcgtggacagcaccaggaataccagtgcaaccatattgtataccatttcaacggcctcactgccatcgcaattactcgaaaagtcctttattctcttgcaggcaaatgctcgcatccgccctattttctcaaccattattgttagcctcccttccgccaaccaatctggatattaacggattagtgaatatccaagttggacatttggtcattcccaccaatatcgttcagacattccgactactgtggaagccaacggaaggtctattttaaaaatgccataagggttggcactcaaaaaattgatacgatatgtgcaggagcccacaaccgtgaaggtgtctttaagctgaaccttattgtcggagaagtattctacgtcttttacttcgagttttcgatcaatcagctgtgtgctgtcacccataaatgaattgaattgggcttccatggctctctgatctacaatgccagacgtttccgccatacgcactgcacttttcgtcgcagagttgaccatcgtaagttccaaaacataaacaaggaaagccagtgcaaccataacgaaaaacaccagcatggccgtagaccagaccatttcaacagcttcgctgccgtttgtgtctttcgaaaaagaatgtatttttctttttatcgagtggaacaccgcctacactcctctctaacttaatgaatatgtctaaaaatctttttagattgttctttcgatataaatgagaaaactccccggactgccataatggggatatagcagcccgggaaagatcctctccgcccggcattagaaaataccagacagtttctcctgtgccgtcgaaatcatcgtgttgaacaggcccggcattgcggccttaacagccacagcaagcaaacctacaatgactaccgcaacgacaaccatgccgatcttctcggtggtgtcagaaccgttggtgtccatcaggaagtcctttgcagctttgaccttctgctgtgcagcaatagccagtgcatttatcttcttcatgggaaccatcctcctttcataaaaaatctgcagattttccaacccctccaaaagagaggaagcaccaaccgtgggtttataactcgcagctcgtgctccctctctttataaaggtttttttacaggattgttgcgaccgactctataactgcctgaatcagaatatagaacatcataataacgagaatgatgccagccggcaggattgctcgtttcatctgaccaggtcgcttatccagctcacgaagaatgagctggcgatgcatagttgtcatgtcttgtgccagatactgaagagtcagagagttatcaatgcccttatctacctcaatcagtgctgcacaaagacgggatatttcaggattactcatgcgactatcaaagcgcatcagtccctgttgaacgctggaagactgcatatccgtcataacgatttcaagctctgatgccattgctggagatgcagtcttcttgtagaggtcaaaacagcgaattatgtctcgatccgtatgcagcgcagattcaatagagcgaatgaacgtcgggatctcattttcgatgattttatatttgttttccagagtatccttcagctggtcgaagttcttaaaaaacagatacaccgccatcagcaggccaccgataatcagcagtgctgaatcgatcgtcattgcaaatatcgcaacaaggatgcccagcatcgcgctgagtatcgccttggcgtaatattcctttgcggtataaggaatgtccgctctggcaaggtcatcgttcatctttttttcgtgatcttgagagagtggaatcagaggggcaacgatcttcaggatattgttgagcgatctgttctgccagatatcagaatctctttttcgccaacgaataatcgttgtcagcgttttgctctttcttgcgtatacatcgtatcccagcagtgcaaggcacgggtaaagaagaccgataaacacgcagaagaagattataaaatgtgtaactgtaatcatgtttgtgcttctccccttctttaaccggtaatcggcttattgatcttcattgcacgaccggttgcccaaacgaggcttccaagcatgctgactaccaatacacgaccgaagaaagtagtaattaggtagttgtaccattcatactgaattacacggatcaacaggggagaaagcaaaatgataaacagcatggtgaagtaatctctccatgcgcttgcagttttggtatcattttctctctgtgccgtctttgcatcgttcatatcatccaggatcggcatcaggtttacaatctgcgacctatctgactgcgtcaggataagttgatcgatccaacgcgagaagaagatattggacaccttgttttcaaggtgtcggaggttgcgctccatattcgccgaaactagctggcagtccaccagaaactcacggaacggtttgtccatatcgataacatcaacagagttttctaccgccttctggatatccaaagtattcatatattcgtgagtgataatacgcatcgctgcttccaggttttctgcaacagcccggcgttccttattacctttgaaaatcaggaatgcgtgcggcaggacgatacatacacctgcaacgcacagcgaaatcacactgtcaatgaatacgagcttgccgaagaaccaaccgccggcaaggctgactgtaagcagggcaaggtaggtcttcatgtccgtgttggttgcacggaccaacttgcgttcgcttacaatatacttctcaatacggccagctttacgcccagtgatttgagctctctgctcttgcagtcgttctttttttcgtttattgcgacgatattctttatcgatgccggaattcatcaaaataattgaagccagcataaagaatatagcccataagattttagcttccaatacaaaacacctctgttacgcttaatccaatcgcacgttcacgccgccagcggccgaaataagattgaccagtgcaaaaataatagctgcaattgcgtagaacataaaaaatttgaaatcatccagccgtataaatgagaaacctgctccaagaaagtaacatatcgcgctagttccggcggcgcctctactcatcttggaagcaatagaggtaattccggctacagccagcaggatagctactatcagcagtgacatgcctcgaatgttatccgttgcatgacccataataagacgaaatgtcccaagcagttggcactgcagaatcaaaaatcctgctgaaagaagggttatgatgccaatgataacttttggtatgtggaatggcagcggcggatctggctgatcgatgaatttcgagaaattgtggtccgggaccagatttctgctttgctctgacagttcctctacttggggaggagctggattgggctgctgcggaggtgcatacccttgcggtgggaccgcagcttgctgctgttttggcattggctgctgccaaaccgacgtgctcccccatggggtcgtcatcggaccggaggacatgcgattcccgaccggaggatatccggttggggactgctgctgattttgtgccacataagggttctgtgccttaggcatttgagcctgttgattttgagtttgtgggactccctgtcccagagcatcgctcacctgttgcattggctgcccacagcgaaagcagaatgccgcatcgtccggcaaggattgtccgcacttgggacaaaacatacttcctgtcacctcctattaaaacgcctgggatacaaacccggcgttcgtattagctcccattgaaacatacgactcgggctgccaatccggtcttgcaaactttttgaccagatccagacggccgcagttatcgaatatacgctgggccatcttatcagacagattacctatgcgtgcatgtataccgtgaacagcagaaaccgaaccatctgcagcatattcgtagttcgtgatttgcagtctgtagatatagtggccaattactcgaacgccgtcaacatcttctgcttcgtaaatacctgtaatcttacgagtaccatccttcagctgctgagtagaaatgatgattggaaacgcgctgacaaggttcctcatcaacagatgttccgacaagtcggtacccgacatcttacacatggtaagaagtcgctgatatgcctctacacagttatcagcatggaatgtcgaccaaacgatatgaccagtctgtgctgccgtcatagcgttcatcgcttcttcaccgcgcatctcagcgcaagagataaaggtcgggtggaaacgcaaagctgactttagcagatccggtgcggtgatgactgtaccgtttttttcatctacaccgcaaacagctgtgtaaataactcgtgcatcttcaggaagctgcagttctcggctttcctcgatgatataaacgcgagcctcttccttggtgttttcaacgtagtcgctcatcaaatagttaaggagcgtagttttaccggaacccgttgcaccaaccagtgctccggagaccttattgcgggtacataattcgataaactcaaactcctctgccatggccgaagtcgcattgatcaggtcttggcgagtgattcgtgctttggtttgcttacgaatggagataaccgctcccttatcatcacgaatgatcggcgggatcataaccgaaacgcggacaccgcttgacatgtatgagtcaactcgcgggttggattggtcaatgaccatatgacccttacgaaccattcgcttagcgatattcaaaacggatgcagcgtcttcaaacccttcatcgagcatatagctgccatcgccggtaatgatctcaatctgcttaggtcccgggccaaacacgttaatctcttcaatgtttggatcgtcaatatacggtgtcaggatacttaagccggccatatcctcgaatatgcgaaccttgtaatcttgaatcgtttctatatccaaagtagctgggtgctgttggagcagcgtgtagatgatattttttaactgcccctccccctgctcgctatccaaagccgctgtcagagaatgctgcatctcttcactggaagagatcttgttctgaacccattcgagcacggccttataagaaattcgtggtgcatcttttacagtctgatcgacataagtaccttcccggacatttctgtcttgacgagccatgttcaacgcgacaaagggattatatgtatcgccattatttttgggcattaaaatccaactcccttctatctaatctatctaaggttattttccaaaaatcccgccgaacaggccttttttcttgaccggctcttctccctcgggatttgtttcctccatcgccctcttacgggcaagctcttttttatgctccttagtaaggatagcatggatcagtgccaaaacagcagcacgatatttcttcgccgcacggccgcctacagttacaatggggcgtccttcattctcgcacagatatgcttcatctacgcagttcaacttgatctcacaatccggcagagggatggaggccagcagctgagacatatcgcatcctccctcacgggtgtctgcatctacgaagatcgtcttaggcataattgcatccagcatctgcttgttggaaatgtgccatgtggcagcagatactctatgcggtacggttacgataacactgtccgcctctgccaaacccatgccggtaaaagtagactccttatggctcgtgcaatcgataaccacataagaaaaacgatctctcagatcgcctaacacatgtcctacctgttcaggggtaatggctgcgatatcaaatgaatcgccgccagtgtccagttcaagaatataaaggtcctggcgtgcaagcaccagagactcacctacattatggccgctactaatagctgcatacaggccttttccctttggcacgctggtaccgaagaacgcctggagctcgccatggtcagttcctgaaacaagacatgtcataaatcccgagtctgcaagcactgttgcgaggttaacggccaacgtagttttaccgctgccgggtgcgccccaaacgccaaacataaacttatccattgacattactttttagctccttctgcggtcttctggtcagcagtcttattcggctcagcagtctttgccgcatcagttgcagcttcttcctgctggttttcttcctctgccttctcgattctcgggtggagcagcatgtgaaccgtgccactgtattcctggtttgccagctttacagcctgctcatcgtttacaattaccgttacgaaagccggaacaagcgaggagtcaaaatctttttcgctgccatcgtttgcctgctggattgaataaaatttgcggtttagagaagttacatcctccatcgcctggttttgaagtttgtatacaattacattcttcaggagggttgtcatctccatctcgattttatccgtattgccaacagcctgaccatactcatcaagagaaaccttaacggccttctgagtcagaatatcaacaacatcgcccggctttgcctgaccacctacagactgtgctgcggagtccagagatagggtgatcagcttatcgccatccttaaggagcgtatcaactgcgccgtcgacttcagaccagtcatcagcaaacatgtcgctgtacaggttggagtcgtggcggatatcctttgcagcatacttgccaacgatgtcactcttcttggtaattacagcagcatccacgccgtaacgaccaatcttcttggtggacagcatctcttccgagatttgtgtaccagcattcacgtcgtcaataaactgaacgacatcttctgtggcttgctgagaaccatacattttcgggagcagcacgaatgtgagaactgcagcaagcgccagcaagataatgctgataaaaagtttacttctgagaaatttgagcatatttttcactctccattataaaattttgggcacaaaaaaaccaactgccacgaacatggtagttggtttgcctttgctttaagcccgaattttgtgagagcgcccatactcccacttcttcacactacaattatagcacattatttttgtattgtaattaccgacttgttctattttgttctacctgtgttctaccttaattccgctcttcagaagttttaaagcagaaaagccgccggcaaatgccgacggctcaactcgataaggcacagacgctccgttccggcaaagctgtttctgataatggattcggaatgtttcgtacactccccagtacaagcttgctgaacagggaaaaatatcatcataccacaaatttactacttttgaacaagccttgatacaatcaaaaaccatgcctatagctatgaggcatggtttttgattctttttcatgtgcagagtttgggaatatgcaccaataaaatttgtctgtttttgtttgacttttgaattgctatttttcagaaaagagtatatgataacaccatagaagtccaattaaccagaaaggtgattatattgagaaaaaaagcattatcaaattcagaagaaatccttctgtacattttttgggatgttggcacaccactatccgctctagacgtttttgagatctcgcaaaaaactgaggatgcagccagttggagtatcaactacatccataaaatgctgacgtctttgctggacaaagagctgcttgaaatctgcggcttcgtcagatcaggaaaaaaatacgtccgtagatttcggccctgccttaccaaagaggaatatattgccgacaagcttgatcagcagggcatcaacacctcatcgcttgccaaaattgcaatggcgcttgaaaaaaagcaggaggcaaaaggaggggatgacaaatatgaccagttcatcgctgaactggagcaaatgatagatgattttgagcaatcaggagataagaataacgaaccatgcaaataacacttttctcattcttttcttcggttttgtggagcagtgttttgattgtcgggatctatgtccttcgcaaagcacgccatttcagaaccagtttcgggcttggtgcattggtgctgctgtatctgttcagcatcatgcgcctcctctttcccttggagctgccccatgtgatcgaattaggcattgatgaggtgtatcccgagatttaccgtttcctgacgaccgatcactcgtatggggagttcctgaacttctcctaccttgacgcccttgtgtgtatctgggtagtaggggtaattatacttacgacccgctacatcgtctcttatcataagacgatgcgcaatatcacaaaatacgcttccccatgcggtcagcacgaatacacatcactgaatgcggtgaaaagagatatcggtaagtcgatgaaagtatcgctttgtacggttcccaatatcagcgtatccttcggaatcggtattttccgaaagacgatattactgccgcaaaacgactttacggatagagagatatattatattctgctgcatgagtatacgcattttctgaaccacgatattcctgttaaaatgatgacttccgtgttctgctgcatcttttggtggaatcctgtagcctatctgctgaaatctgatctggagcagacactggaaatgaaatgcgatgcttcggtagcgcgttatctggatacgcaagggaaagcggattatctgcggacaattgtagatgccataaaaccgagttctatgaagcggcctactccatacacttccacggccctgtttcaaatcggtcggatgttggatgtcaaggaacggttcgatgtggttatgaattatggggctgggcatgataggacactttcgcaaatggcgctgttcctggtcggtgcgtgcgtatttgtgttatcttatgcaatccttcctcagccgaaattcgatgcgccaagcaacgaaaaaaatgggaggatcgagttcggcagcgatacagcctatatacagcaagatgaagcgcaagaatattggttgtacattcaggacgaagcaccaatcaaattgacaaaagacgaagctgagttttatcaacaaacaggcattacaattacaaaggagtaatgaatatgaaaaaaagaattctctgtagcttgaccgcggctatgattatggccacctctattcctgccgcatttgcggcaaatgtaccgccagcccccacatcttgcggtgaaagagagatcgtgccgtatgccgatgtgattatctatagataccgtattgaaaatggcagaaagcagtaccgccgttggaacgagaccagaggatattgggttgatccttattggctcgatgttccaggcagtaaataaaaccgtggttagacggaaaggactgatgcctatgattgcattaaaaaatccacacaaatcgaaaggctggcaaccttgccactaaaatggcaactcgaatttatgtggacgaagatatattagcatacttatttgaccgattcaatagtaaaatcaatctttatataccttatttgtataatgctttgttttacgtctggaggtgcaaacatgaaagttaagaaacgtataattagtgttattctcactattagtatgctcattatctcggtagttcctgcattggccgcagatatttcagtatccccaatttctttcgatgataatgatcaatcttccataactgttattatgcctgatggagacaaagaaacgtatgatgttttctttactgataattcagttataactattcacgacaaagggaatagtacaacacgacttgaaactttttttgatagtggaaaaagtgtagaaactgtttatcaaaacaaagttgaaattttacgcaagacttatccaagtctcttagtgaagcaaagcattaaagagaataatgattataatgtcgaaccttctaattttgtttttcctgagaaatatcagagcatcggaagtgtttcttttaagacaaacagcacaggagtagcatataaaattagtattgagtgcaaacaagattctgaagattactgtgaaaaatatgatctaaacggttcagtaactaaaagtgttcaattcttagtaaacggattgctggcgatgttttccccaatttccctttcctcggaagcaacaggcatagctagcaatgttgtaaataaacttatttctgcgggggtagtagaggttagaaaaattggagtaaatcaaatcattgcagctgtgacagcagactatgtagaaggttttgtaactaattatagcattagatacaaaaatcaatacggggcgtcgaacactggcattggaaaagcaatttacattaagacaaacgacgaacgctttaatactgtcgaatatgacgaaatgtatccgcagtttctcaaaaaacgggatgacaaaattgcaagaatgatttattatgcgtatgatgcgtacggctatcccggtgtaagttcttggagtgcaaccagaaccgttccatattgtacatcctaaaaaatattcgggacaacctttgcataggttgtcccgatttaaaatggtgataatgatgaagagaacattatttatgtcaagcgtatatttaatcttgtcaggcttgataattttttttgctgactatttgacaacaccttttatacagaagctgtatggttcaggaatatcattggaaatagtagtaagaattagatacagtatttcggtaattctttctgttatagtcttttttctttttcttagattctggaaaaaaagagagcaaaatttgttgcaagtaaaaataatatcaaaatgcatatttggttatgtaattttatcgcttctattaaaaacgttttttcggtcttcagtaattataacttgggcggttactattatatcgattccagttaatatttttacctgctattacgattttgtgttagctttttcgactcatccaattgcatatatagttggttttctgctatcattgctcctgccttttttgatgtattatcttatcacaaaagaaacaaaagaattcgactccaaaccataaaatgcgtcaatctttctaaaacttataagagccttataaaagacatgatttcccaactgtgctcgcctcatggatgccaatatatattctgtacgccgttatatccagcaagtcacatttaaaaaattccactcggactcgtgaagttcaagtggaattttggggatgtttcgaaacagtctacttttcgtttaagtaattcatacaatataccaaattgtctgctccaaaatggtcaggccatcacgccagctccggctgaggctgtttcaagccaagctggggctggtcatcttttttgcttaacaggaagttcagttcgttcaggcgttcgactttgatctgatattcatcctcctgcggccacggcttttctgcctctacctttgcattagcgagctggtcttgcagacgcgcgatatactcaacttactttgtccagattaaccttcgttacattcaggcgaatcatcctcgggcaactggatcactgctccccgccccttatgcttcttccgaatccagccctgcacggctttcagcagggtttccatctcagcaggatcgagacttacgagattcaccagcagcagatattcggccaggttggaaacgatgatctccagcggtttcttgccgtcaatgtattctttctgcacacgctctacatcaatggtaatggtttccggatgccagcctttatcccaatcatagggaaaaaaaggtgtctgaaagcagaagattgagagaatatttttgccttagtttctgaactaccaacgttttttgtgctggcgtcgctcgtcttccaaaaccaaggcttgcaagttttttaggtattggtagacaaataagaggcaaggagggctttcatctcggatacaagtaaccgagaattcccgcctgtttcttaagcaaaaagccgccggcaaatgccgacggctcaactcgataatcgttagccgagaatattaacgatacctctattttcgacttattcgaagagggaggcaccttttgattggggaaaataggaagatacgaaaatcagaaatagaggtcgtgcatctgttccatcagatcatcggagatcttaatgctgtcctctgtctgataaattacgctgccggttccgcaataagggcagccgaccgtgcgggcgtccactaagggttcctctgttacgcagtcttcttcacgcagttcgctactatcgaacacatcgatgcagtagaaacaaccgcagcggatacccggcttatgcagcagatggccgttgccgaagctgcgcgtatggagcttttcgaggataggctttgccttctcatcgtcttctgggatctccacaggaagctggacagagaagtctccattctggtcaatagtataaataggtttcggcccaaactgttgaacatcagacatgggaataggagataccagcatgatgtcggctacccaatcgcaatcgaagaaattgttgttctgatagtcggcaatcaggaacaagaatgccttaggcatatagagttctttaaatcgtgcatccataataatgctgcggacgatttcttcgtacattttcttagtgttctcgggagcatgaactcgaatttctacgttagtattcatgaaataacctccaaataaaagaaaaacttgacgcaactatgccgcatataacagcattttcgtcaagtaaattaccttattgagttacctatattataacactatacgcccaaaagtcaatataaaaatatgagcacaaaaaaaggcagtcgttaccgactgccttttcccttgcgcggatgcttgcgaatatcctctttgaggaatatcacatttctcatcagattgtgtcttgtctccaagaaaccatgcggagttatcccctgcatgagctcgatgacttttgtaaatggcttagccataaacatgccatcacgcagattccaaacggataccagccgtacgaactggtaacctgcttggaagatgaataccattcccgatttgtcatcgataacggcaatcgtgcgatatcctgcctcattttctacaatcctgtcatcatcgtccatggagacgtgataattagaaatgtaaggaataattagaggattctgcagcaactctacgcaccgttcgagcgtctcatacctgttgaatgcgccgcgaatacgcattcgcttaaaggcatgctcagaacttacgaacagataatgccgctccgccagggtgatgtcggtaaccgaaaagttttccggatccaacgcttctgtctttagtagactcgagcgaaactgcttgaacgagagatctcgttcacgtcggcacaggaaacgtgccatatcggactgtgtgttgtaaccatgaacaaacattttacatgctccttcccgaccgcttacgcggcaaatggtttttgtggttgttgtgttggacttatactcgctcgaatactccatcaggagcaccaagagagcattttccatttactgatttcgtaaaaacgatgtcgttcttgcgaatttgaatgatgttgccgcgtctattacgcgacattttgaggatatatctatcctttgttctgtgaaagaataagacttttcgcgtttcttcgtcgtaaacgatgaagtcgctgtctttcgggatgttgaattgtttcagcattgccgtaagggatgttttcatgtggtttctcctttccaaacaaaaaaggacatttcatgtttaaaacacaaaatgtccttaataaacaatattaaacttagacacgcaaaatatacatgtcagtggaaacaaatcttcaaacgagaagataaaagagagactttttataaaaatagaataacataaaatgacgctctttgcaagggctgctattgtaaatcctcacagaaatggtttttgtcggagtcctcccctaccatagcggtctggacggccggatagttatgccggcaaatggtcgtccacaacgatctatgagccatcccatgagtttctgtattcacatacagatagccgcaatctttgtctgcatgagttacatggacaatagagatgtccgtgactgcatcctctggagtaatctggagaggagcaatatcaaactctctatacacctgagaaagagcctttgagtcaagatcgacaagccgatctcgaaatgccttgagctgtgcaataccttcttctccaacagctgtaaacgaaaatcgaagattatagtctttcatgtcaaaaagctcctttctcacgcacgtatttgtaaaattacaattactgttctcttgttttttgcgggatcttagcaataaggctaatacatatattgacgaggcagataacgattgcgccaaccagaagtgccgttagcgagtgtgcacacatattgaacgactgtatccacggaacaaatcttgagaaatactccggtgcataaaggatcacagctactactgctccaatcgggatcggtatccagaagccattgcgtggctctttcgactcggaatatgcttgtttaccgcgaaatacacgaacgtttaaattctgaggtgcatctctatctacaatcggtcgcatttctacgaagtccttacaaatttccggaattttctccaacgggactacgcatttgaactgaaaataataacacgtcgtagtagtgtaccttacagacggcagcgacgagagagctacgccaatcaagcatacaactaacagcagagaaccatatgccacgaatttgatccctgtgtcggtatataggcagtcactcttaaagataagcgtgattgctataaagagtaaaaagagcacgctccatatggctgacaacgaaacaatcaaatccatgcaaccaccaagtatttttcctactctctcccgtggagattgcgcatcccatgatttcgaaacctcactcgttgtgctgctctccataaccatcgcaccaagttcctgtaacttggttatttcttcttgcagttgtttcttgtgttcttctcttatgtacaaactgacacctcaattctcttttgcctttgcgggaaacgcaagctgcatagaatttgcaaccaacatatctgcaatagcctgcgaaagctgatccgtgattttagaattgctccgtccttctgcttcatgtgcgtattggagtaaatcactgtcatcccaattcagtttgaagctgccggcggcgttctcttttaccgcattcaggaactggcggaccatgttaactctttcgtcctctgaaagcggaagaacctcatgttggatgggaaatctccgaattaacgcattgtctattgcgtcgattttgttcgtcgccgcaaccacaatggtatgaggcgatagagtgtccatgttctgcatgatagacagagtgactcgcttcatctccgaggcggcagaacttccgtcgttctcgtgatttctgttaaccgcaacggcatccagctcatcgagaaaaagtagtgccttcggatccctggcaacaacagaaaatatcttacctatattttcggatgtctttccgaggaggctgctgacaatgctcgaaagagaaacaacatatatggaacgatccaatgatttcgccaaatgacgagcgaaggtagtctttccagttcctgaagggccggaaagaagaacagctgtacgatatcgaatgcctgcggagactagcttctcgctggctgcctgcatagtaaaaattagctgctctactgctttttctcgttctgacaggaaaaacatgttctctggaatattgagagcgtcgtcgttgacgaacatctgccggtctgatggcgataattccatgagctgcggttgatgtgcgatacgttccttaatcgttttgcagaaagatgtattcttcgcacttccacgactgatttcgtctgtgcaaattacaagtgctgtttggcgtgctcgatcccaatccgagcgggaaatacaggaaagcagcgtgcggatattgttattaagcaatttggtgatatttcctttctgaattgagattgaccctcgaatatggcttagacaaggctccaagcatagtctactccccaaattaacaagttagtgaatgaccaagttggacatccaacttagcattccgtacacagggtttttctgaaatcaacgattccctttttgatgtcgaaaaaaccgtcaacagcgaaaatacaaacgatgatgctgagcagaaagcccatgtcgtaagggatggtggttatatgttcctttgtcaggctcatcatatatgacgcctgaacaataagcgaaagtgaaatctgcgccaatccataaataatacgggtgacgcaaaacgctgcatgaataaacttggtatttggcattaaagcctcctgttatgcgtgaatttgacgaaaaaacgcgccaatgtaagaaatagtgtgtccaacatgagagcaaactgcttctgaacttatgtgtagtgatatgaaagcagctatgaccacgcttgacgcccacatgattcctgacaatatcttatctccttttttccctgatcgaatggagattaagggtaaatggaatttgaaagggatcggccataaaaactgtacgcctacaggattcatagcatctaatatcatatgtataagacagcccgcagctattgcagggctaatgaaatacatgcctattaccataactgcggaatgagttaatcctctatgttgctttttaaagagttttggtattatcggcactctctgacctactatactcgttgatttatctatatctggtaagactgaccccataatcaatccggttaatgttgctatatccgcgcattgcggaactcccataaaatgtccagctaatgcgaccaggattccagaggccaaatgggttgaacctttcacaaaaataccccaaaactcgcttacgcgagtttgtcgaacgaaaagagagttgtcggcatatgcagcgataattcttccgcgcctggaacgatggatagtgtcgttacacatctgatacgtacatcccaaacgagagttaacacggttatttcggaccattccttcttgcccgcgatacggcagtaaatactgattgcatctcttggacaaaaagagcacggtccccaccgtacgtccattgcggaagcacttagagtatccttctgtaaatgcgcacttaatcggtcgcaaaccaactgtataatcgcgctacgatgatgaacatccgccggaagcaatcccctctgcagttcaggaataacttctcgcaaaaccacaagctctccccctaacaatattttcttttgtgcgcttattatatcactaattgattatttgtgcaagtcttttgcagcatatcgcagaattaggaatttatgatcttggacgaaaaaaagaaaaacgcttagcaatagctgctttatcggcaactgcattcgagcatttttcttgtccccgcaaatgcaggggccatgtatttcgttctttggcaataaccaatgcatgcccaacttcctacttttcgcaaaagtagctctggccgatgtttcgcacggatccccgcttacgcagggtaaaccttttacgtcttatgcacgacgggaaattttcgggtccacccccgcttacgcggggtaaacagcgccaaagggaggatttacgttacgcagcggggttcatccccgcttacgcggggtaaacttcgacagatatgctatactgataacatacagaggtccacccccgcttacgcggggtaaacacttgggataattacagaaatagggtggatactcacgcttaaccaataattcgcttggctccaacataaaccgaagaataatatccgtcattcagagagctgattttaatgccactcgcgcggctcgctgcatggatgaatacaccatcgcaaatatacataccaacatgcgaaatctcgctggcggagccgttctgcggatggaagaaaatcatatctcctgcctgtagatgattgatatccacatatgtaccgctgtcatggtactgatcttcagctacacgcatgatattgtagccgaacttgccatatacatagtacatcaggcctgagcagtcgaagccttgttccggtgtagagccgccccatacataagggccgccattaaactgaagcgtatattctacgattttggaaccgagtggatttcgctgctgttcgccgctgtctacgatgtacttcttgtacacttctactgcgtcattagaaccattgtaactctgtccggaaatgctggatatcatggagaagccttgacgaatcaattccgtatattgatctgtataagacttgttctgcgcctcagtcttttcaatttcagcagagcgttctttgatctgaacacccagctgcttctggagttcttccagtttgttatttgcttctgtgcgttcatccttgagagactttacctctgtctccttctggttcaactcatcaatagccttctcgatttcatccatggtattctggtcataatccataacctcgctgatgaaatcaatgcggcccaacaggtcagtcaagctggtcgactggaagataattgaccaataattcgacgtgccatactcctcgaaattacgcacgcgattgcaatatgcatcgtatttatcatccagttcctgattggagatttcgatgtcattctccagaactgcaatctgctgatccagcttggcaatttcctctttcaaatccttcacctgagcagtaacatcgtcatattgcgtttgtagcttgctcttttctttttggatattgtctatcgttgtcttattggcatcgatcttttgctgcaactcctgtcgctgctggaagttgttctcgtagtcacttgccggcgtagctgatgcaggaactacgaatgtagttgcaaccatcaaagacgccaccgcaccagcggtgaatttttttacccatttcttttcacttgcgaatatcattggggacagtcctttcttcatgttattttatgacccccgcatcggcggggaaaactttgcggtcatcagaagagcgcgagctatgatagggtgatccccgcactggcggggaaaacgttaatgagggagtacgccaagcaatgcgcgagggttgacccccgcaccggcggggaaaactctgcaatcgcgtaagtagtaggcaataacgagggttgacccccgcactgacggggaaaacgttaatgagggagtacgccaagcaatgcgcgagggttgacccccgcaccggcggggaaaactctgcaatcgcgtaagtagtaggcaataacgagggttgacccccgcactgacggggaaaaccagatgtactctgataaaggtcttgaactttaaggttgatccccgcactggcggggaaaacaaaacgacaaataaaggttgcaatcttaatcaaggctgacccccgcactggcggggaaaacggcaacagatcaccatcatgcaggtgtagcgaaggttgacccccgcactggcggggaaaacactttaaaaagtgcagaaaaatcatgtaatttcttattcatacgcggagatgcttgcggatagtgattacacttccgacgatgccaacgcccaaaccaagcatcaacatcaaccctgccagaggaagagcaatatccttgtaaggcataaacgcaacgatagaaagcgcacctgatttcgtcatcatgttggaaaccgccgtataaacgccagaagaaaacaagtatgctatgacagcaccgatgatacccactacgcatccttctacgataaatggaaatcggataaaaccgtcgtaagcgcccatcatcttcataacagagatttcgtccttacgcgctagcattgtcaggttgatggtattggtcataataacgatagcaatggccagaagcataatggccaatacaatgccaacaactgttacgactctctgtactgccgaaaatccgtccgaaaccttttcgtctaagcggatatcgtcaattccatcaatagctttgacctgcttagcaatttcgctaataccaccgtgatcatctacctcaaccgaataacgatctctaaacaccgacgggctgagtcgagaagtagtttcatcatcttctccgtactctgccatgtaagttttcatcgcttcttctctagtaataaacgtggcagatactacatgatcaatctgctcaatagacgactgcaatgccattgcttcatcttccgagaaagtctcatcgacaaatgcaagcattgtgttatctacctgaaactcctctacatttgcttgcaggttataacccaacatgaagactacagcgatcagcagcaaacatgccgccgtagtaatcatcgacgtaatcgacatggctttatgtttaccaatggaggacgccccagttttaaaaccgtatccaatctgtgaattctcaaataaacgcattaacggtgcctgcctttcttctgcggtgcttgcggaggcatctgcatagagcctttgtatttaccgaaggagtcatctaccaatttcccctttttgatcgtgataactctttgtgggaacatatcaaccagctctttggcgtgcgtaataataagggccgttgtacccatttcgttaatgcgcaggaacagcctcattatatcgatggccagcgtggggtctaggttgcccgtaggctcatccgcaattatcagcgaaggcttgttgacgatggcacgggcaatagcagctcgctgctgttcaccaccgctcaattcggtgggcaggcgtccgcccatacctttcatcgaaaccagttccagaacctcttcaatacggggcttgatagaagaaaccggtgcatttatacagcgcatagcaaattccagattttcatctatcgtcatgctgggaatcaaacggaaatcttggaataccatgcccatactgcgtcgagcgtctgcgagcgcttttgacttcagattacccatatcatatccattaacgcaaactgatccctccgcagccttgagctcgcctgttatcagtttggagaatgtagattttccgcttcctgatttgccagtaacgaaacacaattcaccatcatttatcttaaatgaaaaatgcgtaagtgcttctactccgttgtcatacgatacgcttacattacgcaattcaaccaaataaatacaccgtctttctttttttagttttataaagcaggcgctctaatacttatgacttcagtcgtgagatacagagcgccgaaaccgtaggcggctcgatgccgcctttcggttttttacgctacgtacactaagcctctattcagactaatgattctgatctttttggcagggaaattttggtttcctttgccatacgcacgataatactgcccacctgagagctggccggttacgacatatcagtttccttcgtactgaaatacagcgccgggcatgacgcggtctttggagttgtagtatcttgtgctttttcgcaccttcagtcctgcccgtagatgctcagccttctgctgaccgtactgtttgacagtgttttcgaaccattccgccagagaatcggttttctgatcggtccgctttctgcggtttcttgcaaccgtctgaccgttcagcttgtaggtgcgttccgtttgatggtgaatattcgcacgattatgccttcgaaactgcttaatttcgtaaacatccgttcggatattaggtttgacagtttgcatggtgccggctgcgatacaataagcatccgtgtcatgggttttctccagcttatgctttgtgcgaaattcttttgtctgccatccgtaggtcagatgaaggtgctcacgatacgtcttacccagttcttccacgagtttcggaatgatctggttcaacacagatgtgccgccataacgttttgtctgacctttctttaaggtcgacaacttctctgccgtatcggcggatttatgtacagcttcatggcacctctggcataaaccagcaatattgttgatggtattgtctccgcgcttgctcctcggaataagatgatgaaaatgctcaatgacattttcttgacacaacagacaggtatcgttctgaagctgtcgaacggcagccttcagtccaccggtaccgtataacggtccatgttggaagtcgatattccatttgtttttgtcgggttcgtccaactgcataaaagcaaacttgttgatttccaacgcaatatcggataccggaagaatgcgagatatgcgttttatcagattcaggtgcgtccgaagaagctgcgttgctgtaggtgtcagccatcctgccgggcgaacacggttgttgaatcgcgcttccgtattgatgatgtcctttagcatgatgggtttctcgtatccggggagtttccgaccgtccggaaaagttgtagccgtttcgtgcttggctgccagacgttttctcgtcaatcgctctcctcgacgggatgcccgtcttgctgctcgccgagtatccatcaggtcgacgatttctttgtttcttgtctcgcaatgggatcgatacaaatccgttccgtcggaacggactgcagccaatccgatatttgttctaccaggatcacagccgagtgttactgactgcaccacatgagttttcgttggtctgtccaactggatcgtgaacggcaaggtatccaccacctttgcctcgccggatttcagcatccgccgaaccttgccgaagcggcaggttggcataagcggtttgccgttcatgtccagtacgtatactggtctcataaataactccttttgcggtaagccagacggaccggtcggacagatgtccttccaatcaatccgtaagatttccatagcataggcacatctaaccggcgccggaggcttgggaacaccgtccgggcgaataatgtgtcgctgctctgctcaatcactctgatatcgttacggacttttacaagcccgtgactttagtcatgggtaattgaccgttcattccatttcggtattatatcactaattgatttgttattcaacccaaatatggtagttcaggtgcattgttcagggttagttataacatttcagctattaaaaccgcataaatgcacaaaacaagggtgaatatatcatccacccttgtttgccttcatttcgattagagcttgaataccgcaagctgcactttgaagaaaagttactaggaacaccatgatgacactccacacaatctccatctgtaaaacagaattgaggattgggtacggtgtatggaataaagccgttcctacgccgtatatgccatctgttgtctgtaccccataggctgcaacaaccaggaaatagaaaatgtcggatacagcccattcggacgccctgacatgtaaatacttagtccagatccagaagataataaatgccgtcccgaagaaaaggatatacgcaatcacaccgctaggataaaaccaaggcaggagcgttggcagaacatgaaactgtattgcgtacagcatcagatctcctactattgcttttatcagcatcgcccatgattgaatttgaatctgcaccgctatcccctttactacggttaattactacgggcaataagggcgcaaaggaaaagcgctgcatctttattgacggttataggcatctgaagatagtacccgtcatcaccgctctcatgagcattggcccaatcaatgaagatattagttgctccggtcctttcgaaggttgtataaatctgaggcttatctgtttccaaatcgtacacgtttgtattaaaaatgcctttttcagcacatccaagcggctggtcgtcgtaatatgtaaaaattcgtttcgtggtcttgatgactgctccgcatggcacatttttgatgtgttcacggaacttacgcacttcggcatctccaccttgtaggacgcccatcagtgctagctgaattgtttcgtctgtatccagctgtgcgaaaacagaatcaaaaaaccgatacgcatttcttctcgacagtatatctccctcaggcagctgcttagttttagttaagaaatcaaccaaatcagaaatattgcgcatcgggccaggattatacgtctccagatctgtgtcgtcgtgcttggcaaacaggcgcgaattaggccagctctcgacaaactcatgctcggtacgctcggccacatagcccagttcctccagttcagccttcactgtattaacctgccccgggacgacatcttgcatcaaacccaagaagtctttttgtggccagacacgcctgctttgcagcgcccgcataaccttcttcccttcggcagacaattccgggtcgatgtcaaataattctttccatgccatatcatactttgccatacttcacccgcttcgacattttcgacatgtaattgtcgctttatgacgaagcacaccctccttttcgtagcacttccaacacaagagaaaaactaaaaattatttttatgttattagtctaatcccaaaatcacataattgcaatactttttcagcacttaaattatactattatacgcgctattattcaacctgtattggttttatattcttatggagggaaatcataccttttgtgcattttgcacaacaccagaacaaggtcacaagaatgatggccttttaaaaacacagaacaggtcctctcggacctgttctgtgttattgcgaagcggacgagaggaaatccaacagatctcctacgtttgcgatataccgcatatctacgcctgctcgctgatattcttttgttgccgagtcgccttttccccatttctgtgggggatccggatttaaccaccatacctttcgcgctcgagtacagaagtatcgaacatcttcttctcggcttgcattccggttatttcgtgcatcacccagaataatcagagtggtttcttttccaatcagagagctatactcctcttttagctggtgcagcgtccgtccataatccgaatagatgcctcgtgaaggtactttatcatttacggcatttacagcagcagaggtgctctgagagtgaaaatactggtccaccaggaccagatgattgacgaaggcaaacttgtggcatccgcccgggaaggcttcatccatcaatgccatgaaatacaaggccacgcttgcggcctgccggcaggaacccgaaatatcgacgagacatacgatctttgcatggctcttaatcggcttcttgtatttaatcatcatgggctctccgcctgtcttagtcgcctgcgtcatggtcgctctcatatcaatccgtcgcttggttggagtagctgcagtccggcgtaaggtctgtcgaaacgctcgggcattcgtgcggatgtatgttgcaacctgctgcatctgttcgggtgacagttgggcgatgggttcagaaagcaattccgcttgctccgcagttgtttgtactgcttttgcgttgatcgccgtaaagatatctctatgatgctgggattgctgcttgatgacaagttcgttatgcatttggatctgttcgatcttttgcagttgttcgtcagcctttgctcgggctgcttccaatctcgtttgtgacagcttattcatttcttggcgccacttaatttcattttccaaatcaattatatggctgcgagcataccgtttctgattctcgcatgcttcaagcgccagctgcttttcttttagttctttatacccatctttagcgatgatattatcacacaaattagccaacatagaaaaattcttcacaactggagcaacgtctcgagcatattgtagatcttgctgtgttgcttcattgagtagatgaagaatgatttttcttaggctgtagcttgccataggaactgctatgatcgagtccagttcactatcatctgcgttagttgccgaagggtcacgacgctgtatcgactcctttgctgtaacgaacgaagtccttgccttatcgagcatcctgttaagctgtcgttctatgcgtggattttgtttagccaattctttgggcgagaacgattttatttcttctttcagctgctcagccttttgccgcaggtctccgtgggtagagtcaaattgtttctcttcctctgcaatctgccctttcagactttgaatgtgcttttcggtagctgagatattatccgacaaactcactacactggcttggaaggaacttagctttctgtgagcatcttggagtcccgcctttccgggggcagtcgcgagtaaatccacatatgaaccaagaaaggtctgaccaaaggcagagcggaaaatgctgatttgttcttcgtccttacagatcatcgactgtaggcgatagacaacttcctctacatccgtaatgtcatgaatgcaggcaagactatcttccaggcggcccacatcgataataaagccatattggtctcgcagcccaaggagaaagtccttgagttgtaggacaatgttattgctcggcattagagatcaccaatcttcttgttgggagtagagttcgaaaaaaccatacgaagaatggtattgcgatctgcattatccttggcgaggaaaccaactgtatagttgatattctcattgatggcgtcccagtcttcgttataggtcgttttcaggaacttcgcccatgcgataccctcactaatgcttgcggtatggttcagttcaagctggccgatctggaagagataatttgcgcagcgagtgcagaattcttcattgtcagaaacctttgccagaagaatttcggtgatttccgccgcactcttagagcttacatacaggtatacgcagcgacgcttcatcgccgcagaaaggtctctgtacttgttagatgtaaggattacgataggacgattctctggtgcgcactttacggtctcacccatctccggaatggtaattgcaaagtcacccagcatttcgagaagcgtatgttcgatttcttcagatgccttatcgatctcatcaatgagcagcaccttccgtcccggcatagtaagcgcctttaatacaggtcgctccagaagaaagttttttccgtaaaatgcaacatttccagccacataacggatactttcatcaacactcatatctttcattgcttcattgagcttatcacgaatagcagatacaacaagaagctggcgctgataatcgtaatcatacaggatggtttccggactgatgccctcataacactggatgcggacgagcgggataccttctgcctgtgccagtgcaacggccaacgaacttttacctacgccgggatcaccctctacgagcagcggagaacccgtttccattgctcccagcaatgcatatgcgatttctttatccgcgaaatagtctgccgtcttgagtttactaattaaagcgtctgcggtcatgcttgttaatctccttctgtcgcattttttctactcttttatatagcattttacagccggtcgcgcagaacaatgcgtctgcaaggtattccagctgcttggggttgcattcagccaagaaccgtgtaccaatatcctccttgaagaaggcgttaacggtctgcggctccgcttccataatcatatctgcaatcttctctactcggcgctgggtaacggaagcggccagtttctcgaactgctgataatcccgctcggcaaaaatcttttgaatggttttattacctacggccggacataacatagtccgaatgaaatcaatatctcgtgccggcagcgcaaagattttcgagcggatcagctcatcttggcacagttcttctatggcatacttgggcagcatccacattgcttcaaccaagtgcagcgcctcttccagtttcaaagacttcctttcaagctcacgcttaatcacttctttttgtgtttctgtattgagatatgcgacgtcttccaatgtatacgatgtaacatagcgaccaaacggaacatttataaacttggggtttacatagtatgttgtatatacagcatacgtattactcatggttttctcgcaaattaagtctgcttgaagcaagcgctgtatgtagtgaggataattctttgaaataacatctgctgccttcaccccccaacagatataggagatacttgaattcgggttatctatgagaaaaaaaagaatttccgcctcaacaggacggaggcaaatgctatccaccacttcattgatttcctcagctatggcaatagcctgactaataaatgcatccgccagttcgtatgcatttcccggctgctttgttttaagtgttgggaagtcttttctacatgttattccacgaggagagaatcttgccttataagagccaacagaaacgcgaacatcatgcaaatcaaccatcactgtgattgtcgggtatgcctgaatctttttgttcttgctgagagctcgttcataagccttcgataaatattggcagaaatgatgccactgtattacattagaagggatgggttgaacttcaggaagcgtcatcacattataatagttttcctcgaggtgttggtccagcagatttccatttgaaggcttaagaggaacatcatcccccattgggaaacagatataaaacgaattatctctcttttcaataaaaatattttttgttggaagatcaaagctataagagaagtgcctttttttgatttcttttcggagcactttcagtgtattggtgatgaggtcatccacgaaagcatgaacatcgctttcatcatgtctctgacgacatatttggaaatcatatcgttcaaagggagcactctgccatatttgctcaacgattgctggcagcatattgtctatctctgtgtcaacatattttgtaaggtcatccatattgacagagagctttagtttcagatctacttcgtagtaatccccttggggatgggtatacgcattgcaaatgcaatagcggattttcaggactgcaatattgtttccccttttaccaaattcggctgcatcacataccgcatggtaaccgggtttcttttgattggccccattcagcgcctgttcaattttttgctttaattggctgctgcaattagcattatagtagctcacaaagtcaacggccgggatagccttttcatagggagttttttctcctttcagaagaggttgcatatgttcagcatccggattttcggctagcacaagaatttgagatataacttctggcaatcttgcttcggctttcataaacaaatcgctctgcattttgcgaatatcccaaacgatattcttgacgtccgatttgacatggtcatttcgtactttctcgtagtaagggaaagcaaaagaatccgtcgagatcttaagcagaattttttcaacgtaaaagtaatcctgtttatactgaagaatgaatgaagcagttaatacgatgtctttgtaatcatatattccccggatggataaatccttaattaaattagccgaaggggatgctgcatctatcaactcgatggcgcgttttttcagttttccataagtctgatccttatgcgaacgtagtcgttcagctgcttttttacgaacttgtctttttaatttcttcgaaatttgttccatgaggtatctttcctttgaggtagaaagccaataatatatccaaaattattatatatttttttgaacatttgtgcaacctttactttgtatgttatacaaatggaggcaacaacaaacggccctgtgagggccgtttgtattgtcaataaagttgcttacaagaaagattccatgacgtattttctcgtaaaatagaaccaatagtccggataatagttccttcgtaaatctctccacggtatttcaaccggaagaatattgccatagagttcatacatttcagagaggcattctgccggcgcagatagcagcaggtgctcgaaattattgtatagcgacatatatgttttatcgtcttgtgcgaggtatcccacgcacaagcggcttatgcccatggttttggttctatcgaacgcaggaaggttgcacggatacttctgaggaataacatgtgttgcgtgcatatacgatggaacatgcgactctaccgccacatacgaaacacccaccgactcgaacaattcagactgtgctgccatagcactgccgatatcgtagacctgtgtaatccccttttctgctgcaaaagcagcagctatagaatatgccaatgcagcaccgttttcgaagaagttgtcgaactcgtattcctccattatcttttcctgagggacatccagaccttttctgtctacctccataatctcatcctttacctgcttgaaacggatgattgcaccagtgggtttggagactttcgtgtgtgtacgatatgattttttcaattcaatttccataaaaacatcctctctctcacttctcagcaaaaaactgtcatattggcgagctgagaacttagtgacatgcagcatattttcgaaaaagagaaatccggcacccctgaaaaggagtgccggaaacccagaacaaattacttgaggccggtccagctttctacgccagatgcagtcttgtaatcatgtgcattggacgcctcgaggatatcgtagtacgcccaataagtgttggacagatcattgtaagaggtcagcttgctgatattctttgcaacgtaatccttatcgcaggaacggcccagaacagcgttggtgatctttacaacctccgagcgggtgatggcattgtccggacggaaagtgccgtcagagtaaccattaacccaacccttctcggcagcagaggtaattgctgcatatgcccaatgattggacggaacatcagagaaggtcttgttaccgccagacagtttgtcgaaacgagctgcaatggaggcaaactcagcacgagtgattgctgcattcggacggaaggaaccatcggtgtaacccttaagaatgccagcgttagtcagagttgcgatttctgctgctgcccagctcttatttgcatctgcaaagctggaagaggttgcagcatactgcttgcgagcgtcatcggaaagcagacggtagaagattgcggaaacttctgcacgggtgatattagcggtcggatgaacgccgccatccggataacccttgatgtaagcgatgtggtcgccggtaaggagcttagctaccttaacctcaagagtatgattttcgcggatgttcttgaactcataggagtccttcgggccctgagacttgccgtcaacgattacatcagtaatagtatagccatcgtcagccttgataacaaaattcttgtcggagccggtcggaacagttaccttgccgttggagtcgcccgccggagtaacagtagagccttcatccttcttaacggtaatggtgttggtagagactccaccgccgccaccgccgccaccgccgccggtggagcgaacagtgtaatgtgcgtatacagtggtcggaacattagcagacttgagagcatccagagttacctgagtgccgccattggcctcggtgaaccaaccgtcaaagttgtaaccagacttggaagcgctcggcagagtggtgatcttgctcaggcctacaacataggtttcagcgttgttagtagtaactacgccgccgtttgcgttaaatgtaacgtttgcgctgaacttcggaactaggacggtaggctcttcgagcttctttacgtcgtcaatgtccagaatttcatccggcttgtccttctttgtccagccatcgaaggtgtaaccatccttcttgacttccggcagcttatcgatctcactctgcagctccttgcggggatctgtggagtcattatcggtgaacttgttgccatccggatcaaaggtgatccagggctccattacggcagtcaaggtgataccgtcatcgtccttgtagtcggtgtactgcggcagctcgaggatgatctcgttgtcgatctcttcccagtttgctgctgctgccagccagccatgatacttagcatcagtcttggtcggtaccggcagggtgccataaaccgagtcaaagtcaaccttgacagtccaggtgtctgcatctgcatcataaacgccagtgctctggtcgaaggtgtccggcattgcagaacccttcataacaaacttaacattgtactttttgggttgccacttagcgtaaacagtcgtatccttagccagcgaaacaaggtcattggctgtcagaacatcgccattgcggacaagcgtccagcccttgaaatcgtagcccggacgagtagcctcaacatcaaacagaccttcgtataccttatcaaaggtctcttcggtgtgatcaatagaggtgtcaaccagctgtgcacgagtagaacctacttcatcgttgagatcgaaggtgtacttgtaagagtttgcagtatatgttgcgtataccggaatttctgcaccgtcagtcaggacagtcgtccagcgatcaccattcttgaatacggaattcgggtcacgcaggtccagcatccaagaaacgaaggtgtaaccagtcagtaccggagtcggcagatcagacagaatctcatcataagtgatgaccatcttattgggatctacagtacccggaatgccctgcttggtagaaccaggattgaatacaagagtgtaatgatgcggagtgaacttagcgtacagcggacgagtttcctcgtaggtgttcgcatcgttcttaacaattacgttgtcgatagtaacaactgtatcagtagttacctgagtagtgccgtcatcgaggaaccagccaacgaagttgtaacccggcttggatgcagtaggcatagtgcccattgcctggtcgtatgttacagtgtggctgtcctgataaccgcccggaacattgttgtttacagtaccagtgccgccgttggacgccgtaaaggtagcgccatcgcccggaacgtaagtaagcgtgtaatcacgcggggtccactgcggggtaaccgtgatagtcttgtcagcctcgacgtacttgtcagccggagtggtaggagtgatgacgtcgccgttcttgtccttccagccggtgaaatcataacccggcttggacggatccggcggaagctgacccgtaaagtcaccgccatagatgatcttgccgccgtccgtgtcgccacccggctcagtcgggttcggcttaacgtcagcagtcttgcgattgtaatacagccatacaatgccgccatcaaatgcatcattgtactcaccatcaacttcggtcgaagaatcggtcggcttgatggttacagttgcattggtggcatcagcagtcatgccggttgcattgcggtcgtatgcgtttgcatagcctacataattaaagccttcaaaggtcaggtcagagatgctgctgattgcaaactgataatcagtatcagtggtaccagtcagtttgtaagagagcagagcgccgttattgtccttatatacggttttatactcagtgtaggtgtctgctgcggagtaaacgccggtgtccggatcacgaacgaggtcctgaacggcgatcttgatagcccagttggtatcatcacgtgcaatccagtgacccgtcagatcagtattctccgccttgttgtaaatggtcgtagaggttaccagacggtcgccatcataccacccaccaaacgcataacccggcatgcgcggagtcggcaaagtgccaaccaacgcaccgaacttgacgtccttaggcgggaacgtgtcaggagatgttacagaaccttcgcctgccgaattaaaattcagcttatatacattgcggtcatagtaaatgtcgaagattgcattgccgtttgccagaaccttgcagtctgtgtccggctttgcagtgaagccctcacggcaccaccaggaacgttcagcatctgccatgatcttgagatcctgatttgcaatatccttgacagcatcagaggtgccgtcattccagtcagtggactggtagaggtaatactttacgccatttacggtcttagtctgagtagagtcggtgtaacgagcattcgcgccaccctctgcaaactcaacccagtgctgaatggtgtacttggtatcagtgcgtgcagtccagtgtgcgtacagatgacgagcggatacgccagttacataaggggtatccttagttaccagctcgccgccttctgcctcggtataccagccgtcgaagtcgtagccggtcagagttgcagttgccagctcaccgtaggtgtctgcgtctgcacccatggtcttgttttccatgctcagcgtagccggtgcggaagttgcatcgccctcattagcgtggaatacgatagtatctgcaacctgcttgatgcgataagttaccagagcattatcagtaagaccagtgatagaggaattgccagtggatgcatcgtaagttacatggccgtcggcgcctgcatcagttacacaggtatcagccagggtctggcctttcagagtggaaagcttcagggatgtaacatcacgagaaattacacgatactgacgctcgtaggacagaacagcatagtatgtctttcctgctgtcagtccgttgaaagtagcaacgcccttttcatcggtggttgcagttgcaaccggagcgcctgcgtaatctacgctgtcatacagggagatctgaatgtcagtagcagccgggccagaaccagagccctttgcaatcttataggttgcggtagttccctgtcgtccctgtgctgcgataaccagtttattatcggacaggccggtaatattggaggtcatagcgtaaagaggaccttcagaacgaatggtcagagtgtaatacttttcaccggatacctcaaacttgatagtgtcagtcagagtgtcaacgattgcatcgtcaacagtgatcgtagccgtaccgtttgcaaaatccggagtgtaggtgaattcaacatccttgccgccagaggttacatgaattacatcctcggtcgggatacgatactcatccttgtcaaccttaatggtgaaggacaggtcatcgtcttccggggtattcttcgctacagtgtcagcagcagtcagaacgccacctgcaatggatacggacgtcagattgtcattcttgaaatctacgtcttcaccgttgatgtctttaccctcgatgttggtcagggtacgaacatcttcaaaggttacatccagggtcttgtaataaaggtacagaccctcaacgcccttataagtcatgtgacggatgtcccaagtgccgcagtcgtcatgccagcccatttcatcgccggtcttagtcggctgaatggtgtaagcatccggcagagataccaggcgataagcctcttccggatcagcggagataccgatgtttgcaccggtggtcgtaccagcgatatccagagtagcttcgtcctcgaggtatacattatcctgtgcaccagaggtcttattgttgttaattacaacgtcgtccttaacagttgcgtttgcggacttgcagatgtacataccggaaccctgctgagtagccttgttgccagtgatctgtacatcatcagaaatatgcagaccgccgtaggactcagtctgagtgtcggcatatacgcctgcgccataggctgcggtgttgtcggtgatttcagcatcatcagagatgttgatctggccgccgttgcacacaaagagcgcaccgccgccagcggttgttgtgttacccgagataacaacgcctgcaccaatgttcagaacgccgcgatcagctgccagtgcacctgcgccgccctgcatagtggttacgttgttaacacggccgcgtgttacatttgtgttggtaagagttacagtaccattgtcagccacgtagattacacggccgtcataggtaccggtggaaccgtaaagatcaacaccattgaagtttacggtagcgccgcctgttactttaatgaagccagactcagtgccgatcggtgtagaaccggtatactgaatcttgaaattggaggaaccgttggaagagaaattgatagtcttggaactatcctcaaacttaagttcctgcgttgcgctgatatcagacatcagcacaatgttgatttcgtccttaccagctgcagctgcgatagcattgccgatggtcatatacggattagtctcagaaccatcgccgctagtatcactgccgcctgcggcgctgttggctacatagtaggtgtttgctgcggctgcgagagagatgttattgatagcatcattcgggtctcccgcgtccgaagcggatacgtcggaagtgtttccagtttcttcgtcagaaggaacatcaggggtaactttctccccttccgatgcaggctcttctgcatcgaccgtgttatcagtagtctgattggcgttgccattatcgctcacaatcgtattatcatttgcatcgatgggatcatcgacagcgaacgatgtaggtgcgagcgagaaaagcattgcaagtgtcagaaccaatgaagtaacacgtttgaatgattttgtcttcatagtcaatcctccactttagtttgtacgaacatttgttggcttgttttttcaaacctacatttgctaaaatggatgagaatgcagggactgctcgaattggacctcttacagtcccctatcgcattcttaccttttgagatgagtcgctaccatttggtagcggctcttctcttttctgccattactgcggcaggacagtttcaaccagctcggtccaaacttcgttgccattctccaccttggaatcatggccattcgtcgcttcctgaactgcaaggtagtaccaagcagaggttgcgttgtccggccacttcttcatagagtcaaggaggctctcggaagtcagtttgtcgcggccaagtacgcggttgattagagtcatggactctgcacgggtaatggcaatgttcggacggaaggtgccgtcagaatagccagttacccagccacgattgcttgcacgagcaatcagagcagcagcccagtggccagcaagatctgtgtacgggttcttgacattctccgaagaggagttgtcaaaacgagctgcaatcgctgcaaactcagcgcgagtaattgttgcattcgggcggaagttaccattaggatcgcccgttacaataccagcgtttgcaagagttgctacagccttggcataccaagcgctggaagctacgtccgtgaagttatgatcagtggttgcataagccgcacgagcgtcatcgctcaggagtcgatagaagatcattgcgacctcagcgcgagtgatagatgcacccggctttacagagccatccggatagccgccaacataagcaatatgcttatcggtcagcatatccttaagctgagtaacaaccttcagagtatgatttgcatcgatatttttgaaggtgtagtcattcacagcacctacagacttaccatctacaattacgtccttgattacgtacttgtcatcaggcttgatcgtgacagtcaggtcgtcgcccttcttgacgttgacatcgccattcggggttacggttgcaccgtctgccttatcgatggtgattttgaagtcgccgctcggtgccggagctactgctccaccgccgccgccgccggcaccgccaccggatgtaccgccgccctgattaccagagtcggttttggtccagtgcgcatacacagtcgtggtgatcggcatagcagtgatatcagacatggagatctgagtaccgccatttaccgttgtgaaccagccattaaaggtgtaaccggaacgagttgcagtcggcaggttgctgatcttggatgtctcaacagtgtaaacggaagaaccatttacgctgccgccgtttgcgttgaagttgatctcgataactccgatcggatgcttttcgggcttgccgtctccgtcggtatccttctcataccagtcatcgcgggtgccaggaataccgtcttcgccaacccaaactttctcatcttcgccgtcgttatcgacgtccttgtcataccaatcgtccggcgtgcccggcttggtgtcttcgccgacatggataatctcatccttgccatcgccgtcgatatccttgccgtaccagtcgtccttggtacccggtacgccatcctcgcctgcgtaaatcttatcatctacgccgtccttatcaggatcggacagataataatcatcgtcagttccgggaatgcggtcctcacctacccaaacggtttcgtccttaccatcgtgatctacatcgtagtcataatggtcgtccttggtgcccggcttgccatcgtcgccggcatagatggtttcgtccttgccgtccttgtcgatatcagcaggataccaatcgtccgaggtgtcaaacttgtcgtcatcgccagcatagatggtttcgtccttgccgtcaccatttacatcatctacatacttcagggtgataaccagaacagcatcgtcctgagaagcagtaatattcagcgggtcagactcgtttgtgccgtacttgtgagtgtactctgctacgagttcgtagcggcccttatccatctcgccagtgctgaacttaccgtcagcatcagcagtgatggtaaaggtcttgtcactgtccatattgcgcacagtgattacggagccagcaagcgggcgcttgtggtcggttactacaatgccagttacctgtaccttgtcggtatccggctttggatccggattcggcttgtcaggatcggtgctgccagagttggaagtatcaacattgtagtcgcggtgatcgtcgccaacctcaacagttacgatgtaattgcccggcttcaaattcgggaattcgtagtaaccgtcagtgttggtggtggtacgctgcagctcattgccagcagcatccttaagaattacgtttgcaccttcgatagcattatcgtcggtatcatggacgtgaccggagatcgtaatgttgtcagataccagatccggcttaatcagattgtcaggatcgttcttgtaagaaccatccgtagcaacatcataatgtgccgggtaggtaatctttacagtgtaatcgccgccatccggtacttcaaagctgtacttgccgtcagccttagtggtcatattccactcgccgcccgggccagaaacagtaacagttgcaccttctactggattgccattgatatcggtaacagtaccagcgattacagcattgctcggctcaactgtggttttgacggtcgtaaccttggaggcatcctctgcaggaatgacctctacttcatattcgccagccttaaggttggtgaattcatagtagccagtttcatccgtctttacggttgcgatgagctgatgctcgttatcgtacagatttacggtagcacctacatacgggttgccaccttcgtccttggcatggccattgatttcgtaggtaccaacagtagtgcttactgtagtggtcagctcatagttggtttctacgcggtagcggccatcgtccagctcggtgaattcgtagtagccgtctgcgttggaagtggtagtcttaatgacatcccactcctcagtttccagattgtatttgagcagcttagcagttgcgccctctacaggagcaccgtctggagtataaacgtagccgttgatagcattagaatgtgcttccgataccggcggctcgttcttaattccagtcagttcaacaatcagtttaacagtggttgccttgtcgatggttacggtcttggtgtccgaagtgcggttgccaatctttgctgcaaactcatacttgccgcctgcaatctggagagttgcctcaccagaagcgttggtctttgcggagccatcacttgcgccggtgtaagatacggttgcatcagaaatcggattgccgttggtatcaacgacttcaacatttaccttgtaagacagggttactgccagtacgatatcggtcttatcctcgccatccagatggatagtggtttcgccgttggtctcgtagctgtatccattgtcgctttccactactgcggtcaggtagtaagtgccatccggcaaactgtcgaaacggaactcaccgtgatcgttcgtagaggtctcaagggtcttggtcttatcgttgccatacttgatagtaacaacagcgttagccagacggttgccctcgttgtcagtaaccacaccagaagcagtgcggtcacccgtcggaacatcagagccagtcttgagagtcaggtcctgagtggtatcacccttaacattgatagtaacagtgtcggactgcttgcctgctgcagttgcgtacaggttgtactcgccaagcagatcagcgttcagaacaatcttgtattcacccttgttgttggtgtataccttacccgacttttcggtgccagcatagtgaacgataccatcagcaactacgctgccgtcagcatcataaacaataccagtgatagtgatcggggtcttcagtttgagagtaagcggcatgtcgccagatacagtgtactctgcatcagcggtctgtccattgctcttgaccgttaccttgtaatcatcggggaacgacggaatagtaaatgtaccatccggaccagtcttgccgttataatacggagtaccatccatcagagttacagttacatcagcgccttcaaccggagcattgtcaccttcacggacaacggagccggaaacagtgaagcgattgattacgaagtctacgccggttacatctgcgccagctaccttaacaggtacgcttgcagttgccggatagatgtggtctgcatcaaactggaagttagcggatgccgtgtactcgccatccattacgcccatcgtccagttgccgtccttgtcagtctgaacgccgtatgccttatcaggatcggagttgagcttgaggactacagttgcgttggaaacgggcttgccgtcctggtcagttaccttaccagaaacggtctgtgcattgaggttccacgaccaaacatcgcccggagtaataccagacggataagacttgccatagctgtctgtatcctgagtggtcttgtccagcagctgagtgccggataccggatactcaatcttgatcttgtaattgtctgccgggatgttcgcgtaagagaacttaccattagtgataacggtctgctcacctacctgctgatccttgctgttaagcagggttacaacagcgcccagcatcgggttgccagagttgtcgacaacattgccgcttacagttacattataagtaacctttactgcattgtcgggagcatcaatgtagtaagtagtctttgtgtcgcccttggtgagttcgaggcggtaagtgcctgcgtccagaccagaaatcgcatactgagagccaccctctacgttagctgctaccttgacaaccttagtagtagtgttgtacaggataccggaatcaaagccgcccggctcagaaccggaaatcgtatacttgccattaacttcacttacctgcggctcgtactcctggtagccaacagatacataatgggttgcatagatttcaccgttacggtacatagcgatgcggtagttgcccgcctcggttaccttaatagcgtaatcacccttagaatcagtcagcgttgcggtcagcagattgaagttgtcaccggactgcttgtacagtgcaacggtagcgccttcctgtgccgtgccaccaatggagtagttaccagagattgtgtagttagtcagcgtggtgtaattgtcatccggatcgcctgcggtcagatactgtgtctgcttattaacagtcgtaatctttacctgataagtgataccagatgcaacggtgaagttataggcgccattcttgtcggtgtaagctacatcaacaatgtcgccgtccgggttgataatttcaaccagagcagaggtctgctttccgttttcatcaagaactacaccacgaatagtggaagtattcagaccggatacgcgatcaaaatactgcgctgctgcggtgtaagtgcccttttcaaaatcgctatcggagatagtgaagtgaagaacacgggaagcatttgcgctgtgcgagaatacaccgatatagctgcctgcagtcaggccatcaatagtccaatgaccatctgcgtcggtagtagtatttccaaccagtgtgttgccgtcagcaccatagatgtaaacatctacgccttctactggatcagtagtgtgaacgccgttatcggagtagtaaacgttaccatctactacacacggttccggcttcggttccggatccggagtcggaactaccggatcagtcgggtcaaccggagatacatgcttgttgacctgctttacgatatccttccacttaacatctgcgccacttactacgaagttgagcttgtcagtctttgcgtcggtgttatcgtaagtgtaagtgctgccatcgtaattaaatacgacgtttaccatgtaagtgccatccgacagcttttcaaagctgtaagaaccatcggccttagtggtagtcattccgacatactgagcactctcctgaccatcaactaccttatacagcagtacaacgcttccttccggaaccggagtcttagttgctgcattggtcttatcggtctggtagaaagccttgccggatgcggtgtagcgatacagatcgctgtcagcggtcgaatcgcggttgacaatgatgtcagcattgttctggtcacacagattaagatttacgcctacgctgccagcgtaagtgtaatcatcatactgatacgttgcacgtacagtcaggagaccctgcggaaggttcttcagttcgtaggtgccatttgcatcagtagtagtgctgcctacagcagtataagtcttggtagactcatcatacagataagcagttaccggaacgttcgccagtttaaactcgtcgctggtgttgtacaggtaatataccgtgccgcgtacatcataataggtgtggctgatagtggtggtaggctcatactgcttcgagaagtcgtatgtctgagtatagccatcattcagcagtgcggtcagcgggtcagagaaaacggaaatggtgtatacattggtttcgccctcgttctcatgaacaaaaacatcattccaagtgtagcttgcataggttgcaagcgaaccatcctcctgttcataacccagtcccgggatcttgaccggctcaccataaggctgtccgttcacaagaagctgcatgtaaacatcagtacgttcgatctgataccagctcttaaccagatcgccatactgactgtcgtactgataatgtgcctcggacttatcgtcccaaattaccttaccagttacagacgtggttgccgggtcatgagtaagtgtgatgttaagaccagatgcatcagtggttgcatcatagccgttcggaacgtcaacaagctttgcagtgtactcaatgggcttaccattatcgtaaacgtcctgtttctcccagttgatattccatgtgctgtcggtagaaccgccggtcaaagtcttcggctcgccaacagccttgccgtttgcgtaaagctgaacctttacggactccggacgcttgccatcacggtttgcatcgtcgttccacatgatctcagcgtatacggtctttgtttccttgttacgagtaatcgtggtttcccatgcatactgtccagtcaggtcattcagaccgccgtcgctcttgccccactcagttgtggacagatagtaccaggtatcagactcaacagaagagccattcttggttgcagctgcctgataaccttcgtcgagcattgctgctgcggtgtcatcagaccagcggaacgagtagttaaccgggatagtagtgccagtggtgcgccataccgggagatccttgatagaaccagtccaagtattgccctcaccagtgagcgttacggaaccaaccttagtgccgtcgccgtaaacgtcaacagtagcactagccggacgtactgcatcatcattgtccgagtcgttccaattcagagtgaagttgaaaccaacagactgagtcatggtgattgtgcagtaatcacggtggttggatgtgttagcggtgtacttattaacatctgcaatctctgccgtccaaacaaccgcatggccattcagataagtcggcaggtctgcgaaagaataagtccaagagtttgcattgtccttaacagcattggtctgggtcaggtgtacggtcttgtactctacgccatttgccagcagtttgatgtctacaccgttggtgttcgggcggtagttccaagcgttgttattatccatccagttaagggtaattgcaaaatcctgctgtgcctgaccaacatcgtccttatagttactatgcgtcaggccgatgtcaagaccattatccttgccgtctacctttgtgtaccagcttgcgataccagtagtacgagcagatgcgtagtagaagatctcgtttgcaacgccatcatagattgcattctgcttcagaccattgatcgtgtaagtccagcaggaagaaccatcgctgccccattcggaaacagttacggtgccgacatctgtaccctttgcgtcagttaccttgccggatacactatccagcttataggtaccgacaacactggtctgagcgtcagagtaaacattgattgtcaaatcagacggacgattgccgcgctggttattggcgtcgaaccagtaaacatggcccgtttcgctgccagtttcagccgcacgcttcagcgttacgacgatttgattcgtctgagcattcgttgcagacaactcaatgtccttagaggtagaaatctgataatccgttgcgccgtattcatcagaaagcgttaccgttgcattgtacttgatcttagtgccattggtagagtataccggcaactggctaaaagagcactttacgtcgtcaacatcaaaattgacggtctggttgtactctgcgccatcaaccggaacaccatctgcggtcaacgtcaaatacaaaacttcgggacggacgccgtccgcattgccattatcgtcgaagcggaaagacacattcatgtctgcctttgcagactgataggacagatacagattcatacctgcggtcattgcggaataggtcttgcctgtattgtcgttcagtttgatcgtgtaatcgattaacttgccattcttatactcatcaagaccagtaaagtttgccacccagatattcgggttttccgcatcagcgttatctgcggtcagagtagcggtcttgcccactaccttctcgccgtctgcgtaaagctgaacttcaacagaagccggacgctttgcatcgctgttgctctcatcatcccagaataccttagcggtaatacccttagtctggataccatgagcaaggtcgatctggatgtcatgcgggtcaatagtggtagtgctttccggagtataggttacttcgtaaccatccggagtagttaccttaatagtgtatactaccggggtgccagttgcgcccttattattatagtaagatgcgacatcctgccaggtctgagtccaatcattgtccttgttaaactcgagggtctggccggtagccttaccgttagcatacagctcaccaactaccttgtccgggcgaatgttgtcattgttattgttatcgttccaattgatgtggccggtaacataaccgacggacggagtatagtacagatgtacgttgctgccctccatagaaacggtgtagccataagtatccttaagattatttctgaagtcatcagaaatatctgccagataagtgatctgcttaccgccttcgctcagaggaaggttggtgatcttgtaagtccaagagttgtcgttaccagcagttacggtgtaggtcttaacaaaggtctttatgctgtcaacctgcttatacagatcaacctgaatggacgacggccgcttgccgtcacgattctgatcgtcatgccaacttgcatacagatatactgtaccctgatcagtgctgtgcgtcagtttgacgtaagcctttgcagagtctgccaggtttgctgtagtgttgccgttagcatccatgtaagatgctgtgtagcgaacaacctcttcttcctggccattagccatggaaatgtaagtgccgtaaatggagtccttaacagcctcttctacggaagcagtatagagaatttccttaccttcttcaccatcacgataaaccgggagattctcaaaggtgtagttccaagtatcagccgtcttgtcgccactcagaatatgctgatatgcagcgccttccatcttctgaccatcagcataaagctgaagaattacagtagacggacggatgttatcattgttctgagagtcagcccactcgacagttaccggaacattctttgtgttcttacgatgagatacggttacatcaagttcatttgcggtccatgaataaccgttagctccatcttcaatgtgtgcattaagatcagatgtgatctcagccttataaatgatttgctgaccgccgttgtatttctttacattattaaatgtataagaccattcatcgacagtcttgccaccattgatagttgcagttcccacatcgacggtttcccaacggtaggttttggggttccactcataagcggtcaccttaatgccaacactatccggtcgagtattgtctcgattgctttcatcatcccagtaaattgttacagtcttatcgatcagttcaatatcacgggaaatgatagcgccggttgcgtcgccagttgcctcattagcactgttcaggtatttggatgtatacttgttttcattatacttggttacctgatcatcgttcgtaactgtcgtggtgtacttaatggccgtgccattaaaatacttctgataatccttccaagtataagtccaagtattgccgtcatcggtaactgcgcaatctgctgcacttacacttgcgagaccggtatcggagttatgaagcggctgctccttgaccttaacaccgtttgcaaacagattaagtgttacagcgcccggtctcttaccatcattattgctctcatccttccactggatcgtgaacttgatatcgtcaccagtcgtgatcaggttgtgatcgagcttgatataagcggcatagcctgcaacatagttgttgacggcatacttgtaagtcgtgtaaacagcgtcatcatacttagaagctgtcgaaccctcgatttcaccggaggaggcagcagtatcatgaatatcacgatagtgtccgtccgcatccgtgtatccaaggaacacgagtttgtaggtgatcttctctgtggatgcatcagatgttgtaataggcagattgtcgaatacgacgctctgctcgttggtaccatcatcagctacagttttttcagctaccagctcatccttgatagaagaaaccagtccgagtttcacgctttctggacggcaaccatcattgttggtaaagtcatcccaccggactgtacccgtaaaggtcgcggtcttctcattccagattgcatacagatcgagagtccagtagccatttttctgcggcgtaatttctggttcggcaagtttaagtccgtcgcttactggtgtcttgctgccaggagtcttagcccagccgccgaagaaatgaccggtggtgtcctgcattgccttcatcagatgaagaagatcatcatagctgtaagtttgagttcctacgagaccggttccttcccgagtatcatagtagttaacctgtactttctgtgcaacccactttgcgtagtaagtcgtatcggcagtaaccttcgcgtcagccggcagcggagtcgagcatgctgcatctgcataccaaccttcgaaatcataacctttacgagagggggctgtacccggctttacggtttcgttatatttctgagtggttgtagattgaccgccaccaggatagttgctatcccatgtaaaagtgtaagtttttgcttcccaaatagcatacagcgtattctggttttccgacggtttccagtttctatctacaggtgtggtggatttgggtgtcgtaccccatcccttgaattcatatccatctcgatacggattgccagggaattggaacggcaacttaaccgtgtaggtctgggtttcgccatcctcggtttctgcagtccatgtaaaggtgccggccatactatatgcacttgttacacctgcgcccggaaggttatagtcgaaatatgcaatatacatatctcccttaccatctggctggaccggagtagttgtcacatcagcatcccactgcgcatagtacaccttatatgcgctatcaggtacggttaccgtagaaccgatcttgttaccgccctctggggcatcataccaaccacggaacttaaatgttacattaccaactgttagtgatttaacatttgtaggggcatttattgtggtcccagtcggtttaagatactctacagatgcatcgctgccggggaggttccaatcaaaaattatagtgcctttaccggggtctattgccggatcgatttcattctccgattcaaaacggaactgcgtgtagtttgtccagttagcacgggccttccgtactgcatcggtcatgtagcctttttccgcaacatacttatcaacccatctcttcggaattcgaacctgtgcataatagtatgtatagctcgaatcactgaaactatcaacatagcgaacactcagcggagacggagcgtattcgttataatactgggatacaaaatctccccatgcatctgctctatagccgatgtaaaacatcgagccgccctgtctattgccagcccaatatgccttgttctggttggaactgttaatagtgcccttgttaaatggctgcgtgtctgcaggcataaatgtgaagtatgtaccttgccagtttggaatggatgtgtccggcaaaattcgattatggaaatcgcaacgaatacggagaaaaccaatgtcgtcctgataattacctaagacgccgttgtcaccttggtttgcggtattatcaatgcccgtatctttagtcgttggtttcaggacataatattgttcgccggtgcttgagtctgtccatagtttggtttccaaccatggaccatccgtctctcccgtgccatcggcgtttttgggtgcctgcatattcatgaaatacacacccgtattgccagaggtaggctgctcaatgcgaatgccaaatcccggttgggagataagccagatgctgcgcttttctttagtgcttgtatttgcggcccctgctgtagggaacatggaaaacaagcagcaaagtgctagcgccgctgatgtaagtctcctgaaaaaattgagtctttttctcatgttacatataacgctcctttcgaaagaagatttatattgtcacactgtttaattttcgcggagcagtgtctcctccttacaatcaaaacatatacgctcccttcacttacataaaaagtccatggtttgcgtagcacctttttaatgatgctatttctgcaaaccatggacttttaaacagaagtggcaaatagtcgatttccccttctgcggttatcacattggtgttaaggtcaactccatagcggtaggacgatcagggcggaggtccgttttggaaaaatcaatcggattgatctgatattcctgtccgttaataagtgcgtgggaattacttctctcgataaatgtaccaagaactcggaaaactccattttcgccagaaagagctcgttcatatatactcttcggcattttaatggtaatttccccctcaggattggagatgtaataagtcattgcacacactcgtgtttccttgttcagacgttcgtctttgacaagaatctgaatagggtatccagcaagcacagacttttgatcggtctgtgagcagtatgtgtagtaacttacggtcttggttacgatctcttctccgcaggtatccaacagattctgataatctgcactatactttccgtaggaaggataatagatatagcgcgtatattcagaccccatcttaacactcttaatacctttatcgccaggagaacggaaatcggtatcattgggtcccgcatcatcgctgttagacggctgcgatggcgttgacggagtagcaggctctgtgggagttgccggattagtaggttcggtcggcgacgtgggtttcgtggtattacccgcgttattctcttcaccgtaacctacagtcgtcagaatgtcgactcgattggttgcgagatcgaacttgacgccgatgttcatatccttacaaagatcacgcagcttatagtagttattgtcggagatgttatagccggtgtaatcagctttatttccatccttaaaaacggatgccttcgattccttagcagttttcgctgcgttagaaggaagcgccatttcgccgccaacaacggtgtacgccttgttggtcgtaaggtcgatccgcttattcgtctcattccaagatacttcaaactgtttggagcttccgttgaccatcgccgcaacgtccctgagtttgaaataattgttattgttaatcatgtaagcggcgccgttaacctttgtgccgtcgacatagattgtattcttggtcggggttgcgttcaccgcgccagcactcgtgagaagcgcagcgctaacaacgccaaccataaacatagtgcgtttgttcatattctttggtcctttctttttcacgaatgaatcatcttcgactccctcaagctccaatgatccatataaggtgggtttgctgtaattacctatattataccataggtgagtttcaacagcaattcttactgttaattttccggacggcttgcgatccggaatctgctgggatgacgagagcctctctcgtgtttgtcaaggttcagcactcggttcttgaagaagcactggctgaaaaaaccaatcttccttttcattgaaattatatcattatcggatttattttgcaagtcttatttccactgtatttcagttttatgtttttactgtgttttcttcttgtagatttaaaaagccgaaaccgcctcaaaaccttggaaggctaagagacggcttcggccctgcgcgattgcacagtaaaaagggagtaacgggcagcgaactcgtatggagaaaggtgaaaaaaccattcttcgctgctctatccgaaatatataaatcatagagcaggtaggatgctccatgatacttcggcgaaacgatacttgtactcgatataatggattatttaatatttttgacgttatttgtataacataagtgctggatcaaacagctatgacgcaccggtctcaagggggttccgcctccctcattatgcgaaaaagctgtttgatccagcactcatactatgccgttggcttagtttcaaaactgaaccgaactgaaaacaatctgctcgaaggagataattactactgaggtgaaagtgcaatccctgtctttctcgattcggttttgtttacgtgattattatatcatatacttataattttgcaacctttattttcgatttttaccatttaattttttcgtgatattatggaatagactaaaaaatcgggtttttattgtctctattctcctttttttaacgaattagtgaatgtccaagttggttatttgaaagcatattttatttcattatccattctgttgttggtttttatgttttattctttaccaaagaaatctggtatgctataataggctcaaatatggcaccgcatgacccgatatatggtgcgtatttgttgaataaaggagtgtttttctgtgaaaaccaaaagaattatcgcattagggttaagtgcagtgtgccttgttggttcgctgtgcggctgcaagggcaaagatactcaaactgacgatggagcaaccacttccgcttcttctgtcgctgttgatgtggaacatggtgacgaagccctgaaggaaataaaatctctcaacgatccccttgccctgttggaacaattcaaaactgttgaggttgattcttcgatccacgacaagactggtactgagatttctcatataaccattcagtacactcgaaacgacgatggatatttgcagaccgcgacccatctcaagtacaacgcatccgactacgcagacgccagcgactattacaccaatacaagcatgtctgccagcactcctcctgcggtgtatactgtttccgaaaatcagaactacatggtttgctacccgacgtctgaattcgaaagcatggttgacaaagagcttatctgctggttcactgatacaacggataccgtacagaatgtaacagaccaggacggctttaagaccgttgaagtaaagagcgtatccaatgaagacgatacttattactatatctgcaattacactatggacagtgactccctgattttgcaggctctcgatatcactgcgtatgccaaggccgacaccgaaggtgaagaagatacagtggcttccaccatcacttactcctttaagtacgatggagagtacgcaccggacggagatacttccaccggcgcaatcggtggtgacggcgcaaaatgcgcactcactctggttatcaatcccggcgccgacgacgaagaaactcagacctttaaggttaaccagggaaccaatgtttctttcaacagtgagcatttctttgaggcattcgccagcaaggatatgaaaactgctatgaagaacgtaactttcgatacctctggaaagagcgctacttattatatccgtctctccgacgaggccgctgagtaactactcgcatcctgcttaactgcatatcaaaaaaccgcagctcattaaagctgcggtttttctgtttctataagttcctctcgaacattttggagttttctcggatctactatcacttccgactctccttgtatgtcccaataggtcagaatatcttctttggcgatatctgcctcgcatgcaaaacctttattcccaaagcgctttgaaaaccatacggccatgtcatgatccgtagtccacgacagcgacattatgtctttcttcttaccagacgtaactccgcgatatatatgtatggttttcggtagcttattataggcggccaactcttccttatgcatcagtagttctttggaacattccttaaagagttgacatagctgtgagtgcgaaaaatttggatctcgattagggaattccacgcttcgccatgcaaaacgcagcagtttcgaaaggtcctcaactgacagatagtcatttacatacttaatgaatgccaatctgtatcctttggaaactcgactaagcagaagcattggatctgtgattttgcaaaggtttttctccatttccttttgccacagttgcaaatcgtctggtttcatcagatccaacatacgcatagagccatcgatatttaatggcgcgattggcgcattggtaaatgggtgttgaactacagacggaaaagaagagtttggctgaatcgggagatataaaaagagaattgctgtttcgattacatcatttacacaggtactctttactctcatcaaaatcttcgctgcggaaaccccttgctttagctatggggatgagcagcgaacctcctttcatatttacgctatcagataattctggctgcgctctaataattttaagtgcttatagcttacgccatccttgacctttgctctatcaagctttcgcagcaagaaagagccactggcccgcctgccccaaacaaaacactcagtaccgttataaagcaccttgtcgtagaggcggaagccgtagacatacttctctgcctgattagcttttcgcacgcctcccttgaggatggttgccctatgcagctggcgattatgatgtcgcacggaccggatggtataaatgtgggttgcttgccggatgcctggaaggtatccagtatggaacccctgtggtccctgcgcgattgccagagcatcattggtgtggctcttgggcagaaccaacagcttttctctggttgcctttgtgatgtagcctctggtctcgataacaggaatcgtcagttcagcacggagccgttgaatcagagtcttccgcatgatgcccatgaaagtggcatctctggttgacttccgcttgcgcttcttgaagtccgctgtggtgataatgcccttatggaatttctcatgacagctctcacataaagcgatgagattgctgggagcatcgcctccgattttacgactctccagatgatgcacatggagccgcacctctttcttttgggtcgcatgtgctccacagcattggcaggtgtacccgtctctccaaagcacgtactggcgtacattgtagtgaccgtacatctcgcccttctggtagtcctctccttgcggaacgggcttgccttcttcgacagctttgataagttgtaggtcaaattcggcggtttccacgactaccttgcttactggcaggatacggcagatgcgccggatggcagtcatgtgctcctgaatcttgacctctacagagggcgcaagccagcctttgtgcttgctgcggacccggttgtcgaaccgaggcttacgatagcgagttttgcggtttcttctggctcgacggaactctcgacgtgtggacagtaagtccaccacatcgttgcgtggctttacctcagcggagaacaattcctccgtttcggtagaagctgaaagtccgatggttttgcttccggcatccacgccgaggatgacttcctgcgtatagccggtgctgccaaaaagcagctggatggtaaatggcgtcctcttcttcactttggctttcccgtcatctaacagatgacgggcttttgccggggagcagggcatcagcggacgcccgtgcttgttaatgacatatactttgttttgcatgatgccttcctccttttcaagattgcggctaaaaattaagccgctcagcctttcggctgtaaagtacccatcccccatgttatctcaaggtttttgtgtgcaacactgctccttaccctcagagctgtttaatcacacaccgcagtgcggcagatttgggtaaccgtccgccggtgcctatacatacattcttgagtaacgtagtgctcgaagtacttagggtagtcaatcagggctcgtgtttccacaagcccccggctttatccgtggggttattgacagaagccacttcccttctgcatgcaataacgagatgtctttccgcgtcttattatatcacttcttgaagttttgtgcaactcatattatgtcgaagcatttacactcgttgttaaacaaccaacttggtcattcactaattcgttggcatccatgttttatatcgcaaaaaacttggacattcacggacaaaagcaataggtacataagttcttgtctatgtggctgcattacgatataatagagatataaccaatttgtagttggtccagggcgcggaaaatgcgtattcaaatgaacggtcacggcaagcgcggtggtggccgtgtgatctatgtggatattttcgagaaagaaaagctatactttctgtttgcataccctaagaatgtgcagtccaatctcacggaacagcaaaagaaagttgttcgtcaaatggtagaagcgattaaaggagagtgaacgatatgagcgaaccgatttttacctccgatctgacgatggaacagattgaaaagaattttgagggtatggatttctttgcagggcttatggaagggctgcaagaagcctatgcctgtgaaaagggtaacgctgttcccggcacaatctctcacaaacgttcgttgccaaatatcgatgttgccgccgttcgcactgcgctgcacatgacgcaaaaggtttttgcagaaatgttgggtgtatctatccgtacggttgaggcgtgggagtgcggcagaagcaatcctacgccaacggctaagaagttaatgtatctcattcaagaggataattcacttgcacagaaattgcagttacaggcgtaaacaaaggtcacaggattaggtttcctgtgaccttttcttgttcgtactcttggatttggcttagtatatatgagagtttagtcgttatccgaaccatttgcgaatatgcagttcacctgtgtttctacttaggcgtatgtcacttcgttctgctctcatccaacaaaatttcctttcgacaaacaattccgtaaaccaaaggattcgctcgcgcgaatcctttggttgttgtgtaacgtatgtaaatataatcaacaatcaccgtatcacgccggatagatgattgattgtttttattcgaagcgctttgcaaactcagtaatcgaactttcgccagaaccttctccaatagctcgaaacttccattcgccatccttgcgatagacttcgccaaacagcatagcggtcttgttgttgtagttctcggagagattgtaaatacacatctcattgtttgtacgagcatctaccagtcggatgaaggcgttctcaatcataccgaaatgctgatgacgatcatatgcctggtagatatttaccgccaagacaatagaggtgtactctgccggcacgcggtcaaggtcaatgaagatctgttcatcatcgccttcccctgcaccagtaaggttatcgcccatgtgctttacagctccggtggcatgttcaagatggttgaagaaaacaatatcctgcctagacttaagcttaccatctttcaacagcagtgcgaaagcatcgcagtcaatgtcttgcgccttaaagagaccggagaagaagccgccggtctgctttacttcatcccagccgaggccaaccatgattttggataagccctgattttctttggacagactaatgcgctgccccttctgtaatttaacggacatttgtgtttcctccttaaaactgcgagcgggcgcgtagagctctcgtacccgctcgcggccatacacaaaaggtttactcagcgtcgataccgtactgtgcgcacagggcagctaagccgccagagaagccgctgccgatggcgttgaacttccactcgttattgtggcggtagatctcgccgacgaccattgccgtttcaatggaaaagtcctcgcccagatcatagcgaatgatctcctcgccggtctcatcgttgacgatacggcagtatgcgttgcaaacctggccaaagttctgacggcgcttgtcagcatcataaatggtaaccgtgaaagcaactttttcgatgtttgccggaattgcagacagatcaataaaaatctgctcatcgtcaccctcgccatcgccggtgcgattgtcacccatatgctttacggagccgctcgggtgttccagattgccataaaatacgaaatcctgatcgctcgtgcacttgccgtttgcgccagcgagaaaagcagaggcatcaagatcgaaatcttgtccgccgtcgtacttgttggtatcccatccgaggccaaccatgatctttttcagacccggagcttccttagataagctgattttctgtcccttgctaagattgataggcataatttgttttctccttccaactcttaagtaaaatattcatcaggctgaagccttgcacagctccttaaaaacccgattaaaaacatgatagttctgatcccggcgtggcggacagtatactgcaaactcaatggtatcgaatgcgtaacgatgcctctgtacaatggtcttcatcgcggccgcgaccacttccggaggattgcggaacgcaccgcagccaaacgctccaagaataagcacttctgctccctttgccattgcaatctggaatactcgctccatgcgcttctcatgcagcttctgcagatcctcattcgaaatagaaatcgaatgtgagccgtcactcgagttcatggcatttgtcgggatgttcctcaaattcggcgctgcgcaggtaagcacatcgacgcaataccactggctttccggcatgtgcttgggaacatcgtcatccgtcttgaaaacgacaacgcccggtgtgtaaatgcaatcgtcattgtgtagcggatttcgctcatggcgatgcggtacataaaaggcattccacatcttagcattgttcaggcaaggatacaacgtggagcaccggcaaatcgcctcttcctgcgccgacgatccacgagtaacgccgccgcccggattggttgcagacgcgaaattaagtacacagaccttcttgcccgtatatgccttagccgcctccaacgtgcgtttccgactcacaatgatctgcgctggagtaccatcgcaaacttctgtatgcgggatcgggagtctcccccaaaatatatcctgcatcttgcgagactgcttaatcgccaaactcaaatacggcatgtccttgcatgttttttctgtatcttcgaaaacgaaaacattttcacttttccccattggtatatcgactcctacgcctgagcttggtttaacttttttgcgccctgatagttctcgaactcatctttgaggacggccagccgcttcttatcctcttcgcgctgcttgcgagcattctcttgaatagccttggtctcttcaatgccattcataatcgttctccaggtggtctccaaggtctctaccttaatagagctgccggacgccagctgtgcagtgatcttggactgagcgacagtgttctttgcgttcttgatcagcatctcgttggtttttgcgtcaagagcagccatagactctgcctgcaaacgctgacgcttcaacataactgcctgagcaagtgcctgcttgaataccggcagcgtaatgataaacgcagagttgatcttgcggaccagattgagattgctgaactccatcgtcttaatcatagggatagactgcatagccacgttctctgaaatacgcagatcctgcgtgcgctgctcaagaatcatcagggcattattcagattggtcagttcaaactgaatagaattatccccggtggaagcaagggcttcttctctctctttgatatagctgcggatttgctcgcagccaagttcaccagcaagaatgtacttcacgaggtcatggtagtagttcacattagcctcaaacatctggtcgagacgatggtttgcttgtttaatctcggactcgtactgcttgagctgaacgtagatcttatctacttcgttgcccatcgtattgtacttggccataatcttatccaactgcttacgcagattgttgaaaaaggcgccgaaaagtcctggtttttccttaatctcctcaatgtcaaatttggacattaccttagccagcgtattcagaagctcattggagtcatccaattgagacatattgacgctgttaagcacaacatccgatgccttggaaatttcatcagctgcttccgcaccgaacgatacaatagtatccatattattgatttcgatagtgttaagcagcgcgtctacctctggactcttagcgagctcctgagtcatctgctgacgatccgcagcaatatcgtactccttaactaccatatccgtaccgggctgttgcgtaactgcgatggtatcctgctgattcggtttcgtgaaatctattgccaaactgatcagatcctttctacgaattttttgagtctttctcgccagcctttattggccgcaagaggaatttcggacatcttcggagggacaaggttatacatgtactcccctatctgatgttcttcgcaaataggtgaattaaagtattgttcgaagcactggtagcccgttggagcaaagaccaatacatcaaaaccaagacgattgagaaacgaggtcatgatagcatcctctaaggacaagccattttcccctgttactgcataaatgatttttggatttctctttgtaaaatcgaatttattcagaagctgcagtatttcttttttgaaattgagaaccgtggagagaataatatactctgacccggtctcgaaagtgcctctgaccagtttgctgacaataaactgctccagattatccagtatataatcctgtatcggctctcgtaagaagcggtactggtataccggattctgcttaatagcagtcctctgcaaacggttgttcctccaaaaatgagtggcacacggtttgataggattatcatcttctcggcggataaaaggaacccgctcgataaaaagggtatccggcgtaacgagctgcttgatagaagcccagtacgctgcgacatctccatccttaacgccagaaaccttcgcaaagattgtaggcagaataacgacgtctccctctaccgtgaaattcggccggaaattcaactcctgatcccacagaataggaatttcctcgtagatagtctgcaatactatcgagcgtgcttttgaatattgctggttccggtacaggcctgtaccttgatatagcagagtatccagatctcgctcggcgtggtatgcaacagtgccagactgaacatccgccgcgtccttgggaaagcgtgttataggcaaggtgtttttatacgaaatgacctttatcccttgaccaaaataattcgcttctgttgcgtggggcgttaagagaagaacatccacaggaagtctgcaaagcatttcatagaatagctgttctttctggtctttactttcacccatacgaatcaggcacggaacctctggcggtttccatccatcgaaaagcggtgattgatacttctgcatccaacaaataaggtataccgcaatacctgtgagtttttccattgatgttgaaaccatctcaggagaagttaaggtatctacaaacgcttttctcattagggactgaagttcatgattagaacttctgaagttccctactaaagaagatatcatctgctctttcgtctgatacttatcacgtcgaattgcattgatagcttccactgaaatttcaggggccttatcaagtacaacaatacgtctgcccgacgatttgatagtggcatacatctgatatagatcagggacatatgttttcttattatcaactccgcagatctggaacgcgcagctatggatttcttggggctgcgcgtttctatcgatagcctgtgtctttataacttctatccacggagtatcatccgcgatccatgtattcgaacagacattccacgaagcaggggctccgtataagagtcgcttctgttcctctgcctgcacttcttgacgcagggatttgagggagaaattctccggaaaacggtctgtacatgttggaactgctaaagtagaaagtttggacgcgggatcatatttcagatactcactatccccggcatacatcagccagactatatcgcagccggctttgtgtaaaactgagagcagagctaactgatacatacccggtgttgcttcacacaatatctttgggggaaccgtagaaccaattcggtttgaaatacgctcgaacttataataaagccaacacataattttgatatatgcgttttgcaggatactctcggtcttccttttttttcgcaggccagtaagcacatcatatatggcctctgacattcgcgtgcgcggagttgagttcatacgaggaagccatacacgaagactgtccgatataaaaccaacatccagtttaaaaccagaaggcattatctcgttataatacgtcaactgttgcggtgtgggattttgcaattctccttctataactacaccagcgtgaacagcttccatataatatttttttatggaagcctgaacttctggattaaaggaaataacgcgcaaaaattgcgtggtagttcggtttggaacgaagaaggtatcaaactcgcttacatgtatatttgagtccatgaagtttctccttccccagtattgcacgttttattattcagcgtatattggtattatatcaccaatggaatttttgtgcaacctttgacattcccgctgtttcagctgtgagagcatcatggttgatccccgcgcacgcggggtaaatgtatacgacatccgcagatagggcaatcactaaggttgatccccgcgcacgcgggggaaattcacaccagtaatctaacacgaaagtataaccgggttgatccccgcacacgcggggtaaatgcaggcatattagcacgatctgtcccagatgcgggttgatccccgcgcatgcggggtaaatcgatgctctgcgagccggaggcatatcgaattgggttgatccccgcgcctgcggggtaaatgctggtgctttcgatgaacctgtcgttcacctggattgatccccgcgcatgcggggtaaatcttcttggttaacagtgattgtagcttcaacggggttgatccccgcgcatgcggggtaaatgcaaaagataccggccgccttgccacaactgcgggttgatccccgcgcatgcggggtaaatgcagaaaaggacgccaccatcaccgttaccctgggttgatccccgcgcatgcggggtaaatccttttacgccgttacaggagcactgtatctaagggtaatccccgcgcatgcgggggtgaatacgcaccggctgtacgccctcttcatcgacaaggttgatccccgctcatgcggggagaatcaaagatatccggacatttttctgagatatcagggttgaccccccgcgcatgcggggtaaattcacaccagtgatctaacacgaaagtataaccgggttgatccccgcgcacgcggggtaaatttgagaacaaaaccatcgccgaggatctgcataggttgatccccgcgcatgcggggtaaatacggattagatcagttcgcgatattttcgcgtaggttgatccccgcgcatgcggggtaaatcatttggatccggccgaactggggcaagtcatgggttgatccccgcgcatgcggggtaaatggtgaagcacgagaaaagctcttgcgaaatgcgggttgatccccgcgtatgcggggtaaattaaagttgcaaactgaatcaaatagtgataggttgatctccgcgcatgcggggtaaatttacgctggaaagcacagcagttttcgatcgccggttgatccccgcacatgcggggaaaatcacgtcccatcgcaagctatatccactagctgaggttgatccccgcgcatgcggggtaaatctcagagagcaaaaaagggtcatatcgaacgggttgatccccgcgcatgcggggtaaatataacgaaaaaacgaaaaatggcaaactaaccggggtgatccccgcgcatgcggggtaaatacttaaaaatgttattttttatgcagtattgttttcagaatcatgttaatggggatgattatgaatgcaagaactgcacaaatcagccaagaatgcaggctcagacgttcgacgctaagtgcctctccgccaaaagtgacgaagataaactgcataaccaagatggcccccatgaccaacaggaaattcttattgcgtccaatattctcaaagggattaaaatggtctgtacgtgcgttaaagccgttgaaggtaatcgccatcatgaaggttgcaaacagtgcagatttgagatatgtcacatccacaaggccaaacagattgcgcacagccggcaggaacaggatcgacagacaaatacccgtaatgtacgctgcgcttacacaaactcgaatgagcatctgcttggttacaatactctccgaacgcggtaccggcttatccttcataaactccttgagcgccggctcactgccaaatgcaatggctgccagtgtatccatagccaggttgataagcagtaactgaataaccgtcagtacaaccttttcacccagcagtgggcccacaaaacaggtcaggaccgctgcaacgtttactgtaagctgaaagatcaggaatttacgaatactcttaaacatggtgcgaccgtacaagattgccttttcgatagaagagaaattatcatccagaatggtgatatcacctgcgtccttggcaacttcggtgccactgcccattgcaaaaccaacatcagcctttttcagggccggagaatcgtttacgccatcaccagtcatacctactacgtaatcaagctcctgagcgatgcgaaccagtcggctcttgtctgtaggaagtgcgcgggctacaacacggagattaggcatcatggctttcagttcgtcatcagtcttctctgccatttcagcggaggtaatggcaatatgttcattcgaagtgaggagaccagcttcctttgcaatagctacagcagtttctttacggtcaccggtaaccattacaacctgcaccccggccacctggacttccttgatagcagcagccgcttctgggcgaacattgtcgcggatactgagtacacataacagtgtcagatcgccttcatccgagtctccttcgatacaagctacagcaagcatacgcatcgagcgggatgcctgtttgtccatgtagaagtccattgcagcatggtcttcaaagggcttaatcttgccctgtgtatccataaactttgtgcagcgagcgatgattttttccggagcacctttgataaaggtcatcttcttgtcgtcggcttcaactacaacgctggaatacttttttgcagagtcaaatgcgttgaacttttcaatacagctcttatccaagtgctgtgccattttctcatctaccagatatgccataagtgcacgatcggtggagttaccgccgataacagtgccatcatgtgcagcgcttgcactattgttaatgccaataccggttgcgatggcattcgcataaatatgagatacgctggacagagatgtgaagtgtttaaggtcaccagcagaaatctcaacgaccgagagcttgccgctcgtaatagtgccggtcttatcgctaaaaaggatgttaaggctgccagctgtctcaaggccattgatcttacgtacgagaacgttgtcctttgccatcttgagagattggaatgacaggaggatggatgtcagcatcggcaagccttccggcactgcacagacaatcacggtaacagctaccgtgatagcatcaatcagtagtcgaacccaatcatagacggagctagggatatcgccagttacaaacgtcttaatcagaataccgagaacaatagcgattgcaccgatataaccaaacttcgagatctgctgcgccagtttgccgagctttacctgaagtggggtttcacgagtatcttcctgtacctccagtgccagctcgccgaaaagggtcttatcgccgacgaccttaacctgcatataaccttctccgccgcagacaactgtgccacggtagatatagtatttgttcagcaggtccttgatgtcataggactcagttccggtgcaagggatcttttccgcttcttcggtctcaccgtttaatgcggcctgatcgatttttagagagccctcaacaacttcgccatctgctgggatcttatcacccgcttggagataaacaatgtcgccaacgactacttcgtctacatggatctctttcagttctccattgcggataaccttagccatctccttggcgttttcggctgctttcagtgcagaggcttttccttcctgcttactttcactgacagaagcaactccgttggccaccagaatagcaatcagaatgccaaccggctcaaaccattctgcctgtcccatacagcaaagaatgacctgcaccaccagagcgaccataaggatcatgatcatcgggtctttgaaaccctcaaggacctttttccataacggatcaggtggaatttgcgtaagcgagtttgagccatgctgttttcggctctgctcaacttctttgtcagataaaccgtttctcataaatgtatcctcactttctgtcccaaaggaacaacatcaacgaattagtgaatgtccaagttggacattcttttttctttcccgaagatcacagcaatactacttgctcaaagatatccgataaggccgcagacagcaaatacagcattgcaatcatggctgccagataacccagacttctacttgcattcttcagagcaggtggcttacatacaaaaacccaaagcgcaaatggaacgcagcatatgcttgagatagagaatgcctgggtttgtgtcagccccacgctgtatagttctctgcatgcaaatgtcgccaaaccaacattcacaatccatataggcaagaaacacacacttgccatacgcgctcgagttttgcagaccgtgcgagttgaaaaatacagatctccgttttttacttcaatgcaggaaattcggataaccaaagctgtgagcatcggaatgaatgagcataaccaagtgtaatacatgatcacaggctatgcctcctcaccatgtttcgctgtgtcacccggcagcaaatgcggcgcatacttccggagcattgtaacaatttcttctgcgttgttgtcatccagcgcaaagcagccaaagcacggcacgaaatagcggtgcttgcagacggtaagggctctttgtaagtaaacaggaacttctttcccctcaccggaaacatggttcgcatacaaactgaggcgtcgagccatggtttgtaaactgagatccataatcaatttgagttcaggagcgtatttgtaatcaccggccacatgcatggtatagcatatactctgagcaatgctattgaccaccttttgcttatgcggcgtgtacagtacgaaataatctgccgagtgcatgtgcgcctttaagaggaaacgagcaatcgtatctgcatgctttgagcagaatggcttattggtcgctatacagcagtatgtagcgccgtttggcttaacaatgctgcctctactctttgcgagctgcgaatagatttcagttaagaagattgtcttatcctcatttttgacaagaaactcattcagttccttgcaggttcgaatggtcactatctccatcggcttgggcgatgcatgtgttgtgataacattcgtttcacgcagccacttggccggtttcaacactgttgggtcggttgtgttcttgccaatgaaatcgtcaccccgccaaccactctcgaaatgatattcttctatagggtatccttgagagtcagatatacgagtaacccacatacaagagtctgtaacctcatagcgaattgtatcaggcagctcctccggtagttcacctcggtggattgcaaggaacgcttctttcgaaccacaataaatctttgtggattgcccataaagaataccttgtttctcgaatgcttgcaccttcccgtatccggtcaaaggagttctcgcctccgactgaagatactccacaaaattgaagtcagctcgcgcctttttcatgacgtccgcatccaacttaaattttcggaggcagttggttgctactcccagaagccgtgctttatcgaactgagtgcctacacaatcttggaaataatgctctttacaataggttaccatatttcgcaactgagtgacggggatgccttcttggctcgaaataacagggtatttcgtatacgggaaaatggcacggaacgaaaatactcgtagattagcgtacatctttttaatttgcagtgccatggtatcggtgaccagctcatccatgatttcgtcttccccgttataagcagcacccatggtgtcagaaatagcctgtgcgatacttggaagcaacgaaggtcgcttttcacagaacagaacgatatattcagccgagtgaaagtaagcattaactacgccgtcaataatattgttcgcatctatttggttaaatacggaatgcacttttacccgatgtagcaagttgcaattcgttcggatgaaatagtctcgctcatcctgggtggagaagatctcaataatctggatggtctcgaattcatagtcttctatgaattcgttaacggcatccacatcgtgaaaggtataaatcgtaggtcgtgttgatggcgctttcgaataaaagacattggaaacatacctatccctcaataccgcaggagcatctattgtgggccttaatacatcgtaggagataaagtcaatgatttgtctttctgtagcgaagtaatatttttctgcccagcccttccctgtttcattgcggatcgttaagcaccaccctgcagagtaggcgttacagtacgacatcgtggcttttctcgtatcttggtccatacctgtgtaccgaactataaaatctgcataccggatacctgatttattgatctgctcaaaagtgtacagacatacggagattagtttggatttttcctcatccgagaccatttcctcgagcagatcatatgccagtgcattcgaacactttaaggtagaaatgattttacgagctgtatatcctgcgtagcagaaggagtcttcctcactgggtgtaaagccacgacaccttccgtagattgccctttcgtctgccaatgccatcaaattgcatcactctccttttcgaaagcatcgtctaattccttatcgatttgtttctcacgttcctgcctgcgaatagaaactatctctcgacgtgatgaacgccacatcattaacagcataacgcttataggccgtgttcggttctttcttctggctttcttgacgcagtgcaaactcgagtcgtccggaacgtaaacgccaacatcccacgggatgagtttcttgacattctcataaacatcctcgggcataacgtagtagttaaaatccccgatgaaattatgaccattcttcgaatgaaagtcttcctcagatgatttcacctcgtagcaatagaaatcccccttttcgatacctgaaaccgagttgtttgcaggcttgtacctcataaaatctacgcgtatcgagtgttcagaggcgtagtcgaacgtaacctctttcgcccagtaaatacgagggtcattattggggtctatatgctttttaaccaaatcggatatcttcgctgtgatttgtggtctgctgacagaagcgctcatgtgatttcctccaagcattttgtgtagtaaagaagctacatccctgcatatgcagggaaaaaaacaaagttgtgtaagcatcgactacgaaatcaggttgacccccgcgcatgcggggtgaatgcatcatcatacaaccactgcacctgcacgtgaggttgaccaccgcgcgtgcggggagaatccttctggttctggatgctgcccgagtcatcggggttgatccccgcgcatgcggggtgaatgcgcgtagctacatagtaagcgatctgtgggagggttgacccccgcgcatgcggggtgaatccgatatccccttcgaaaggactgggggtgcggggttgacccccgcgcatgcggggaaaataaaagtacaccttttgacatcttgcaactgccaggttaccccctcgcatgcggggagtattttctacgccaaagcctgtccctctagttatagggttgacccccgcgcatgcagggtgaatagactggctcgtagagccactcgcgcgaaaggttgacccccgcgcatgcagggtaaattattcgcaggtggcaaaacaatattcccatgctggttgacccccgcgcatgcagggagaattaccaatactaaactgtgccgattgttcggcgggttgaccctcgcgcatgcggggaaaattgcgtccgcaatggccttggttcgaagctgacgggttgacccccgcgcatgcggggagaattatcgctatgaaccaagcatcgttaaaacattgggttgacccccgcgcatgtggggagaaacggcatccggaacgagaaatgcgaaaagatatgggttgacccccgcgcgtgcggggagaatactttgcgttgtttcatgcgttcttctgcaaaaggttgaccccgcgcatgcggggagaatatataaagatgttgcaaagatacaaaatctatcgaaaaaaacacggattgttaccctacgattggtgctacttttttgatgacattcgaaatagcatcaacagtccgatcatcgtctacagataaaacgagccgcttgttggttctgcgcagcaatgccaacgtaaaagcgtcacttgcacaacccactacaccttcaaccagtacaacatgtgtgttggctttttcaatgctctcaagcatatcctgtgcgcaaatatcttcgtccgcccggataaccacggccgcagtgctattctcctgagtaagcgaaataatattagccacttctgcagcatatacaccgtcgaccataagatgatgccttttaagccactcagcctcccattgatgctttgaaagactctccatctcttttttctggcgtcccacctcacccaaaatgtctttcgactcttcaccgggcacatacataggcatgctgtggttagcaataccaagggaagcagatgccaatgccataaagtcggaattgtacttctgaaaggtggtcttcatctggacctcggcgtcatggattagttgctgcttttgagccagttcattttcagcctcggtaatcctggtttgcaacagagagtattcttctcgaatagccttttgattctcaatgtcagccttgatatccgcaaggaccttctcttgttctgcgcaggcctgctggatttcttcaacgaatttggcttttgccgagtctatgcacaaagacttgatagcttcgttctcccacaaggtttcgcagattacttttgatgtctcgtcctcatgttggatttgctgtgttagcgtgggcaaatacttctggatgccggcaccaatctttttcgagattttagagtcagagacgcctactaccaaacccacggtttcgatagagtcggccgctttagttgctgcgtccatgatgcaggcaatgtctctctttgttaggctgcggtcctgatgtaaagcaacagtagctttggactgatccagataacgccgcataaaaataagcgcatattgcgacgcatcatatggacaaaaagaacctgtccgtcttggcatttgagctaggaagatccgttccggtttcgaagtgcttcgttcataacaataagagactgtgccaatgccatagaagtcaaccaatgggattgcatgtagcgcccgaacaccatcttccggtttgggaaagacttttactttgaagaaggatctcccatcttcgatatactcccaattttgagtatcagtaagtaaaaggcccctattatcaccgttttcagaaggaacgctgagcacgagcttagtatctccatgctggaaacagtttttgagcgcgagcgggagagtaaatcccttacgcagaatgccttttacggccttctcgtcctctagaatgacattctcaaactctttcggagtgaagatttcatagacaggctgctgcgaagccgtaaccgaggcggtaatcttaccgtttacaaatgcccacgaaatcatgcttaccgccataggaccagatacaaagtccgtagaaagaagttctggctggctgcctctctgaacgggatacaaaactctatttgcgccgatgtaatcgccaatacgacgccacagcaatgtattattgtcatcatattcacttacgcataacgacagttgttcttccattgtaaaacctcttttctcttttaatatttgctatatttgagcgtgtatttttttgagccataagcctttcctatacaaggcattattacatcagttgtaataacaggagtaggctcttcatcctgcgcggggagtgcttcatactcatcgtccagagagtacaaatcattaaacatgggccacggaacagactcatcacagaggataacaccatatctttctgtgatataatcgaccattttcacgtaatctggagtatttttgctataatcgaattccactgaacaaacagagtattctgcatcggcgtcctttaatttcgccaaaccaagttcttgtaccttgacgttatacgcttcaaagttattattgaggcgcttagtcggatttgtaatcttgtctaagatgatatatttctgtttcgatgtaataaagctgcccgtcgggagcttctcatatactccatttgcgacgatacgaaacatggcaccactacaactgcttgatgcaaaggtgtcgagcaacttcggtgatagtcccaggaattcttcgagcgatcgagtctcaccgttttcttttcgaagataagatgcaaattgtgccttctttgggactgtgttatggagatctacaaaatcagcttgaggcgaattaagcaatatagaaataggagcttgagcctttatctcatttccacagagcatttggtattctacaaactgacaatattgttgcttggccaatttcttctttatcttccctgtgagtgcaacggccaaggcgaaagacccttcttttttcttgtacaagaaaatgggtgttctgggatgttccttttgagtgggagacataatacccggggatgcgtaaactctctcgctgcattcctgtacgatgcactcttttttcttacggtgtctaaagaatggatttctgaagaaaccgttgccggcttgtatcagatataatcgctccgtacattctgggcatatgtacggcagcaggttgagttttcttttcgatgctgctactgctgagatctcaacgactttacccagttctgcgggtagtcgaacatatgctctatccattaggaattcacctcgcttttgtggatttttccccgcatatgcagagattgctgtggcaaatgcaaaccactttggaacccccgcttgcgcagggaagctcttctgtacttgccgttttggttttcggttcaaccccgtcaatgcggggactatttgtgtacttattgcccattgaaaggcccctgccaatgcagggaaagttgcgcccccactggacgtccttcttccttacgcttgagccaactctgcgaaagcagagaaaaggcgtgatacgtcgaaaggggcatctgtttctgagaaccaaccccgcatgcggggaattcaaaaagcagtgaattgtttgaatcaagttcgcgtcggaacgtccctgccaacgcaggggggatcggatggcgagattcctaatatctgcgagaatggggcatccctgcttatgcaggggaattcgttttatttgctcaggtcagcggcgaaggctggggcacccctgcatatgcagggaaatgttcgcatacctgcacccggacacgccaccgtaggttgacccctgcatatgcagggaaatgttcgcatacctgcacccggacacgccacacaaggttgacccccgcattcgcggggaaatatatactcacctcaactgcgcccacaacatcatgaggttgaccccgcgttcgcggggaatattatttctcttgacaccggctgccaatcatgctaggaagacccccgcgttcgcggggaatattctgtgccgaggtatttctcaattcgcgctcaaggaagacccccgcgttcgcggggaatatacttagaaaattaaaattttgcttgcttgagttgaagtcaatccaattcaataccgttttcgtaagcaaaacgatgtgcatgttcctcatctggaaaattcccggtccaataaccgtttgttccaacaacaacgaggttgtaacccttatcattggattgttcgatataggcccgatagcgctgatttgtatcaacaatgcgatgtactgcttccttatgagatgtctctacatattccttttcagaattgccgtccttttctttacgcttccctgctcgtgtaacgataaaaggaaaggaaccgattaaaacaaggagtgcaacacatccagccgcagtcttgatattggcataacgacttgtgtccggtggagctttatatttctgatccactccatatgtaacaccctcaggtgtcgaagatgttaccttttggggagtttcattcgctgcaatcgccgttcccattaacaaacaggttgcagccatggctatgcagccagattttataagtgatttgatactcatatattgagaatccttccttctattgcaaggtatttttaaaaattagtataaagctgattccctgctcaagcagggctaaatccttcaccataaatgataacgggttcgctccatgcgcttgcatgggaaatcatcagctgtgcaatgctgaagcatattcataagggccatccccgcgtatgcggggtaaactgctcattttgtagggttggccttccttacgcaggttcatccccgcatatgcggggtaaacaacagatactgtgcgattcctcgcatggctttaggtccatccccgcatatgcggggtaaactcttaatgaggttgtcgatttgcattgtatcgtctattgagacagtaatttatactcaaaaagatgtaatcgttttcagatgatgcggcagcgaaccgattacaatcaactgtcgccgtttatccagaaagaagtaaattctcaagagagaagcggaatcatttcttactttcaagtgcagctttaacggatgcatcttctctttcgcattaggcttatctgcatatgggatgtgatactgagttgttgtatgcgcgattgtacgatcctgtatcggcgctacagaaaacggacgttgatacttcaaagaacagttattgagcatattctcctgcgacagcgaaccaaatacagtttcccaataatctgtgccaagaaagtccagtgcatcacacagcagtgtaatgtcaacatcacgggactctctttgagaaagcatagacagtgctctgtcgtgaaggagaatccttccgtcaaaatgggcagaaacccatttgccgatatctgaatgctttgagggtctatctatgcagcgacgtagatatgaaatctcaatcctgtctgctgcttcttttgcaacaagttcttgacggcagtcatccagctgctgcaacagcgccgttttctcttgcttcaaagtattctgatactgcttgccacgggacacctgttcagacaaagaaaccactgtcttttccaaagccaagattttttcttcctgttttggatttgccgattgggtttgaagaatatcggattcgaaagactccatatggttatctatctgggttttcttgttcatcaattcttccagagcgacctgatcggccatataaactggttcaatactctgatgcttaatggcataatccatactatgttcgaaaatacctgtatcctcaaagatctttataacttcttctacacttgtcacatcggtcagatcgcagaatttgcaccgtccatgaaaaatgagaagggccctgtttaatccaggacagccgaataccttttgaataatttgataattttcgcaaccagaatagtatacctttgcttgaaaccgaagtgcctttgccaattctcccatatcatacatgggatcgtcggcaacaacaatcgactctggcagaagatcgtgaatatctcgagataccatttccggcggtgtaggtttgaccttatacggaatgttcatggggagtggagggatcatcgtctgcgggatttcacgagattgaggcgtcagcaaaacgatcagcattccattcgcttcatcagcatccagcttggctactttcattacggcggagcgcgtatcaagagtctgatatgaaccatccatcaagacattgctgcggaatgtgatatgttcctcgtcagccaatctcttaatgagagcagggactccatagaaaatcggcaaagccgaaggcgggtcttcttcatccaacacatcaatcgtgaatgcgaaataaacctctttctgaaactcacgaataccgacattgaagattacctgccgaatacttccccgtttgagattgttaagactgtccagaagcgaccaatgtatacaatcggtcagcttcatcgcccacatgccgttttcttcgataagactatgaatgtctagagagcagcccatcccgtctatcgaggcagaatgaagcgggtctgtattcttttgtccatcaaccagagtaggggtttcttctgttgcccagcggaaagcagccttcgccaccgtcttaatcaattcggtatttgtagctgtattaggacgagacatccgagctgccgagaactgataaatccgatgccatgtgccctgctgcgttctgtcattttttaaataagtcggaacaatttgaagttctgacttattcttctgcgatttgcgtttctttttcttcaaattgtccctcctctcttgtggtacgcttcccctgcaaatgcagggatatgtcagaaaggcctataacaagcttctgttcatcggctaaaccccgccaaatgcggggagttgtgcaatcgaaaagcagggagctttctgttgcccctaccccctacttgcgcagggattatgacacctctcgaacgggcagctaagtggtgccggcggcacccctgcgcaggcgatatttgaaacgcactgtaatatgcagggatattttgcacgctcatccattcactgtatgtaggtattatatcaccaacaaagattttgtgcaacccataaacaacgcttgtccgtgttcactctatgctcataatctgaaaaatgggaaaagagccgaaccatgctaatatcacaattcggctctctatgtactattgtttttggcttcgcaggactccatctggggtaaaaaaagaaaggcatcatcgaagtttcgataatgcctcatcttggtgcgggcaacaggacttgaacctgcacgtcaggaacaccagaacctaaatctggcgcgtctgccattccgccatgcccgcgaatctgtcaatagtatatcatggacagatattttttcaaccgccagtgcaatcacagatgttaacgaattagtgaatgtccaagttgatcactcgttctacacataaaactcacgcatgtcctccaaccgcaggcatgcgagtctacgaagtggagtgcgatttccgcatccgcagtcgatatctaccaaccctggctttttccatatacgaaacggtgtatcatagtcttctgtgagccggcatgtaacggtatgaccgacgattacggttacgcccggtatgatattctccatatccggtgtaatgcacttccaaagacgtgtttcctcatcctgtgcaggatacccatgtacgagcagaaacctgttctcgggaaatccatctgcggatgggacggcaagtggtaccatcgtcggcgcccgctcgatataacgcaggatatcatgcctctcctgtcttgtgcagcgatacataagatcccttctcgtgcgtgaaccaccgttcatcagccaaagctcttttgcttggtagttgtacaccgggccgatgtcgtcatacagaagtttctcgtggttacccttgatgaggaacatatttggctctgccatgatgtggcgcagaaccctcactccatcacggaacctatctattgtatctcctatcacaaacaggtagtcatcctctgtgaactggatgagcttaagcatctctacgaaacgatcgtattctccatgtatatctgacatgcagtaatgcatggtggatcacctccttttttgtctgtgaatattggttttggccttaatagagcagtgcatgaatgtgggcagccgtaattcccggaagagaagcatggggggcatgtgagctccgtttgaaatcgagtcgccggatgagcgtgagtttcaaggatggacctcgttacaaactcactactgcaaacccgaaagcgtgaatattcccatccgctgatctgcggaagatgagttactgctgttatttggccacgacttaggcgattaagcgatgcgaaattgtttaatcggggatgaggatacatcataactggttacggttccggtattgggatcaatgttcaatgaaagagtcctcatagaagcggccttgtaagtaagatatccgccttttattgttgcataggttttatctacgccgctcccccatgcaatgtctccttttaaacgataacaccctgcgaacattcccccgctatcaactacattgcttatatcccatttatcagatacgtaaatggttgacaagctggcacgaccgtagaacatattcgacatattggtaacatttgacgtgtcgaaactcgtgaggtcgaggccacaataatattgagtatccgaattacccaagtcagtaggcggcagttgcataagcgttgcaaacatagaactcatgtttacaacgctagatgtgtcaaagtttgagagatctagcgttgtaatctcgcagaaattgaacatgccttgcatattctcaacgttagatgtattaaaagctgagagatcgaaattcgacagactgctgcaccataaaaacatgttgctcatatttgtaacgctggtcgtgtccaataaacttagattgtcgatggattcaagatttctaaagcattcagaatcattggatgagaacatccacgacgaatccgcgttagcttggatttttcctgaaccattacctgcaataataagctctttaccattacgatagcaagtaatagaaccagtattatcgacatcggcaaaccatgtttcgtcggcttcggtggatggcgtatagctatccgtgaatgtgatttttgttatcgtacggcggtctttactcgatttataccacgaagaacctgctgccataaccgggacgggcatccggatgaagaatgtaacagtggcagccgtggaagctggctccgttgagagagattccggtattctggcctcatagggaataggcagagaatggctggcggctatgctgctaaagccggatgtattaacgactcccgaaacgtccatccaggacccgttaattcccatagaaatgaccttatctccaacagcggccgctgcggcctcatccttggttaccaatgaccatccattctgcgcagtaacattgatcgacgatacgatgatgggagaactactgtagtttcgaatagctgcattcgtggcagtagtaacggtaccgtctgatgataccgtaataggcagcgaagctggtacagttgcatcaatgtttacggcatgcgcactgcaacacaatgcgatcaccaacaacacggacgcaaccagaacttgtactgccacatgaataatcttgttgtgtcctcgagatgagtgataattattctcctccgatttgtgaagcctaaataccgcgttcatcgttttccttctttccattgccttcaaactcactttcgcaagcccaatgatacacgagctacttcttcggcgtgggtttgaaacacaagcctgttcccgctcgaaactcatccatatagctgctatcatcgccataccggatgagtttctatcacagatgggtcatacgagtcccaatgagcaaatccgcttcatctccagcagccactgctcataggtccgtacgctatcgagcaataccaaccggttggactctttcctttcctcctctggtctgtaaatacccagttccagtctgaggtcgtccaacgaacaagaattgctgatccgttcttcttcggacaacttctcaatctcatccagggacacatgcaaatcttctcgggctttcttctgggcctcaacagacgtcccgttaaaagacatattgaagagcgcagaggcgacgaacgggatcttacctaattccgattggtcgaagttctcgggcagcactgtggcgccaagaaccatctcccaaggactgaattcgtatccatacgaattcggaagataattcgcagtatcctgtattattttcgtaaagacttccttcgggtctgtctcttggtattgtggcatatttctttctgagataatgccgtgtttttcgaggagtgaatcctttagaaacaattccgcgtgagtttctggagatccgctttcgaaagtcggtaatgccaggaggatatactccgaaggcgctacgggaaggcgcgagagcatttctccaaagtcctgcattgtatgagcgatacgctttgcggatacattgggctgaagaaaagaaacccattctttatggatagatcctatctgtagataatcgtccttggttagtgttttcagcaaatcgtgcaatatcacgcgcattcattcctttctatggcgtctactgtgataacagaggcacaatcctgtttattggcgatcaggatcttgcctcgaatcaacaaaaatatgttcggatatatcaagccagacatcatctgcataaccaatattgtcagatgatatatcgttttcacaggggtaccgcacatatagagaatgataagatactccagagcctcgtgcacagaccaagatcttgtcaaagagaccggtgtctgcaagtttgcacacttcgggatatccgatgggatcagttgttgcatcagtataaacgatatgatcaagtgccaaacgctctgatattaaacgaatatacgttggtggtatcatgaaatcatagtaaatccttgtctttgtatccatgacaaattcctcctttggattatctataggtgaagcagaagatgctaattcttcttcacctgcgagttaagtataaaaccacctgctacaccgcagctataatggaaggtgaagatctgctgcatgcggttatagcgcacggttcctttttgaaccaggcctctttcaaccatacgttcgagtagttttttgactcttcgctgtcgttcctcgataggagcagactggaatgcatcatccgatataagggcattgcctgcatcattgacctctttcatacggccgaagtcagtcgatgttaaagggcctttggcaacttgtccccttcggtatctggcttgttccatgcctacttgagatcgtcgagcatgagaggcgaacgccgttgcagcagagaatacacttttcaaggttcttcgaattgggcttttatgcatagaaatgagcaacgagtcgcactttattattggggaacagagaattgcgactcaggacctccttttgttcttctctgtgtccggtactgcaaagtaattgtatggggatttggatgggaatctcatttaatccatcccattgaggcgagattatcaaaatattgttgactctcaaggatgtcctttttatctttatccccagaaccagtcctaacgacaccatatcgcacataacgctggaaggcatcggcaaagaattcagcaccactagtctgacgtcctgtcgcatataacgttccgctccatttttcagagttgcgaataatatcgaatgtcttatatacatcgacatccatgccggatgtctcaattcttttctgatagtaatgccccatctcatgtaggagggggcacgcatcggccagataaatcactttctcggaatagactgtcatcccgttaatgccataaatattctttcttttagaatactcgttgatcctgtctacgtcaaagcaaattttccagccttgggaaataaaatctttccggataggctctggaatgagtttcatgctcgcataaaactcattaaattgctgttgtggcaagccctcgactacgcctttcatctctgtgacaataggcaactccggcaatgatttcgtgtttttctgagccgcatggataatagaaaccgcctgcgctctggtaataagttctaatccatttgcatttgtaactgttaaccccaatttctttgccgtgtttataccatcgttcttggaatcactacttgttccagacaaaagcccggaatacacctgtgtgccgttggccgttaatgcgtaattccacgcgctatcagcctgaattgcatcatctttttgcaactcaagttctgcaccggagtcggtccatccacgattcacagcgcggcggagatgataaagcatggaaccttttttggctccgttatcgtcctcatcttgtccgccttccgaaatacttctggacagcatcgtacaaaactgccctattgttattttcttgttcgggttgaatttaccattataaccttgcgcaattccgtttttcgtagcccattggatgtcaccatagtatacatcagacgaagaaacatccgaatatatttttatatcagctgcctgtgcattcggcattgatccagcgaacaacaatccgacgagcatagcagctgataccgcagcaatatgtttattctttttacgactattctgcataatagcattgacctttcacctaatgatttttcaaatagagcagcatctccaaagaaatacgccaataccatctacttaagaataaaacagatggtattggcgtatgagtttcacacaagaactattgtgtcatatctatataggcatagggaccttagcatactgattaaaaacaataatgcaaataagtgcagttactataaaaataatacagacgatttcgaccttgaactctttcttgtgtagtttccacgctacaaaaatagtaatggcgctaacaatcgcagtgatgcttatcatttcccacaatcctgtaagttcatatatcagattcatcttatattacctttctgagaaactgaacttttcttgcttgcgttcagagggtttttcatttatacgctccgcgcagcgcttatttatcccatgcaacagtaaacacaacattcgcagcggtcacagcgttttcgattttggtggataccgcactggcgattgcgcctacggtgatgggcaatccgttgtttccggtgtttttacccgtaatccgccacttggtagaatcaatggcaggagactgactgccgttcttgctgctggctacggtatttccgcctgctgtaagcgacagacccagtttattgctgccgaccttttcggctgcgagcttggagcgatcacctccattatagtcggtcatggtccacacaccatcattcattgcaatggcagtaaccttgactggaccagcggaattgttgatgatctttacatcggacggagaagtgaccttgctgtcagcaccgacgacaagcggaatgctggtcggaactgtaacgttaaaggtggaagcggctgcagtgagggttacgggagtgctgccggtgccgggagatgaaatcgtatcactattggctgctttgtattcggcgatgatattttcgagacatgattggcaaattccctcaccgttataaatagcaatatatacataagaattgtggtaacgcattgtattagaatttaccaaattgggaatatccgcaacattatatgcatcttgatatgattttgtgagatttaaatcggttgatatttcggtataggatttggaacatatggaacaaggaaatgttccaatcgccgcccccgccatcgacatcatcgacccaagcagagcaatggcagtaatcacgccaccagaacgggtgataagctcttttaatctcattttagacttcctttcaaaattgatttgagattatttcaaacagtataatgctgataaaaacagtgatttacgcccaagccacagtgaataccacattagcgatttgagtgtccgaaacggctgctgtccgggcagggaaaagggcattataggttacagcacaattctgacctttagcgatttgggcattaagagaatctgacagaatatcggatgttccgctgtttgaagtagcaacggtcttgtcaccgatattcatctgcaagccaaactgcttagcgtctactggcagattaagaatatctctgttgtaagccgcaagagtccaattactctgactgttcaattcaaccttggtgacagccaccgtggcgccgctgttattgatgatagcggtatcagttgcggtagtgacgtttccatcggcatcgaccgaaatcggcagggtggtgggaacaacgacactgaaggttgcggcttcacgggtgacgttgacggggacggaagcggagccggtggtaggatcaacacttttgtcttttggatttactacataaaacgcccccgccactgacactggcaccaccatcgatgccagtagagcaaaagctgtgataagtccgccagtcctgccaagtaaatgttttaaattcatgggttatgactcctcctaacgacaaagcatatgtattgctgctggcaactttgagcggggcccctgtggcgcctcgcatctctgcaccaccgaattagtgaatgttcaagttggttatcatgattaaaaaaatagctggatgaagggttgcccagagaaaatcggagcatgcttatagagatgaagccttatgctcaatataggtcagaaatcaccctactatattagatagtctaccacatctgtgtcccgatagccagtgcagatgtattctttctcaatgtattttcttgaggatggcattctttgtaggaagtcttgctgcaaatcgtcaatctcaacgattacatggtatgtgtcttttgaaacaccatagaaagcctccaccctggcatttacgaatttgatcgtcaggaccacagctggctcgtatatagattggaatttcaataaaaccaatccggcattcttgtttaggcggaactcctcttcggactctatatcactgaacagcattacggttataggggaattgcagctctgtgccatgtctgtaaattctttcagggtcatagtatcgtctccttgtacgaaaatcatttgttgtttgcagcggcgctattcggaatcgtatataataaaaaattcaatcgcaatctcgcggttccattaaccatgtaatcttctgcgaatcagatatcctctgattgtggtatatgacccccctgtcacctatagaggcagacagtcatggttgggcactgccttaacccattcgactatgctcccttgagtgtatcaatatcatagatagtaccccctatgtaaggcatatcccatacaaagcacagtattctcctatctatgttagacagaagatatgtggtcggccaccttctctgttcatggatgagtttgtactcgtgcctcggaggtacatgcagataatgcccgatttggttattgggcaatcagaacacttgttattggggattggctttggtttcagtttctgacttgcggatgagtgagtttgtagtgagcttccattgagtttgaaagaggaatccactctattggcaataccatgcgagtgagtttgaaaataagaacttcaatgccaccaagttaaccttcccctggtatacaaagatccccctgggtttgagggagtatacctgccgcctcagaaagtaaagaatgcgcgagcgggcggtacatttggtacaccttgtgcaaagggttttctgctgggttgttggaatagttcttctgtctacgatagactaacagattgggcagcttgtccggccctccctgccccattgctgttctgttattcatgctgtttacagcagcgatatacttttcagaatgagtggaaacaaatatatcagataagcagactgccattactgcgaggattaccctttcctgagcctcatcgttattaaccgggattatagcctgatatgatgaacgatatttttttgtttcgggttgtatatatacaagggcatctgtgttattacctttgttaggtttcgcgtcaatgaatgcaaaggaaatagaaacatcgttgggttcgtgctggaactcaatttggctccgtatctttgcgagtgctttttcaagtagcttatgccggccagcttgctgtacaaccgagtcaaagccaaatgccatatactctcccacttgcgtcatttgagagaacatcatagagggtttctgtctcttacctatttgtagacggataaatgtgtttagggcaccttccctttcaacacacgttatcgaagggaaagtagagacgatagacgtatgggatggaatacttgttagtccagcaatagacatgatctcgtagaatgagtccgtgtaccatgcagatggttcttctgaagacagggatatgagtttccgtcccgcctccgtgaaatcactttggaaaatagccaatgtggattgtaatatatttttcttgatatccatagacttcaccttcttctatgggatttttaacaaaacaaaggccagagatgctaaaacatcttctggccttatgctttgtgagtttgtaggaattacagtaacgggagaacaccttggacggaaaacattactgtctttatgataactgcggagaagaacgccgtaaccgcaaacaacgtgagaccgatccggcattctttcttctgctcaacgtttgtggttgtcgcgtactgatgcacgaaatgaaatatcgaaacggcataggtcataactgcaataacaatgaacgccatgagtttcatgcgggttgcctccttttagaactgtgtttcttttgttggttagattatatcactaacccatttattttgcaacccttatattatgagtttgaaacaaaagccgctctcacacaatagagagcggcttgactttcgaaatggttagagctgtacatctgccggcaggcgaagtacgcgctcaatctttgcatagaggaaatgacgctcatcgttgtgattggtaatacgaacgcgaaccagagttccgcgaatcggaggaatcgggccattgagcatcgggcacatgcactgaacacccttctccagttctacgaaaatacgaccgttcgggcgatctgcacgcggggggtcaacataggtgataacaccctcgcagaagctgccgtcggtgtaaatgttcatcgctgcaatgcgcgggtcgttttctgcctgcttcacagaggcctggtaagaaacagcgtaattctgttcctcgttacgcttgatctcagtgatgagaaccttaacctgcttacctacctcaaagcgatcatcagaacgagcgtcctgaagcatgctccaggagagctcacgggcgggaattgcggtctcgacgccatacagctctacacgtactgcgccacgagaaacagcaacgatgcgggccagggccttatcgccttcgttcacatacggagcgccagtattggtagtgccaaaccagtattgaatgcgcttacggcgcatagcttccttacggtcgccgccaacaacagaatggttttccagatcgccctcctccgggagctggtcaacgacaaaatcaatctttgcgccaatgcgggactgcaggtagatacgcattgcatcagccatagtgcgttccgggttgttgttctgataagtgcgaagcagtgcttcctgatcaatgtccgagaacttgaagtccgggatgtaaacctggtacgggccataagaaacgattgcgtagtaaagcatctggttatttgctacgccgctgccacgctcaaacaccgggcggacacccttgacggaaccctgcagataacgcttgctattaaaagactgatacagatccagtgcgcgacggcgcttttcctgttctgcttcgtcaatgtaacggaaagacgggtcggcgttatgaataacattctgacgctgtgcagagaaatgaatggggcgaacctgcggacctgcgctgcggcgacgctggctctgcgcacgctgctgctggagctgtgcttccagtgcatcagcagcagcaacatccgctgcagcggccaccggctgtgcttcatcaatcggaggaagtgcgtccggcagttcctcccctgccatcggtgccgtttcttccggagtaagcggagtcggctgggacggcagagggggcattgcctcaagcgcttccggtgccggttctgcaggagcgggctgaaccgggttttccggaacaacaggctgctcattaaaagtttcctcgttcggattctgcatgttcgggttaatgttttcgtttgcgttcatggtataaaacctcctaaagataatgtttattaaaaaggcgggtcaagcctttttgccaaataattaaggcacgccttttaataacgtgcctttgtcttattgtagtaatcagaaatccgagaaatcatcagatccacttactacattcgagctgctaacgaattgctcttgcattttcttttgttttgcttcacttgcctcctgtttcggagcagagcatgtctgctctttagcggtaggtggttcggtctgctgcggtttgggagatataggagaagctggaatctcattttccgcatcgagtatgtcttcttcttcgtcttcgccttctggtttaggcatcgatgtttgactgtgactagtgtatgtcgtttgaacatctgctttaggttgcggcatatgatagttctttgcttgctgtgcccatgcaggagtatgttctttcatgttgacgaattccaatgtggacggatcaactaaatcggtgtaagggaatttatcaagaaccacaatgtccgcgccggccgggaccagaacaagtttgccttgtgaagccaacttgataagttctgtctcctgcataacgctgcgttctcccacagaataagacatcgatactttttcaggagcaccgacgttcataatagatctgtctactcttttgttttccaaagcaatcgttcctgtgcctgctcgcttggtcaggtattcagctgtactcatatcattacaagcaaggcatatgaagttcgagcagttggacagtagcgactcccacattccgttcggatattcctcttgcaactgtgcaaggttctggaagatcatcgagatggagatacctgcggaacgaaccgttgctagcttctgttcaaagtctggtatcttaccaatcgcaataaactcgtccatgattacattaaccggaacgtccaaggactgagacttacgcgacattgccaaatcaaacagcttatcgaataagcaggagaagaacaacgaagagataaatctatatgtcttgtgcataaccggcataatgatataataagcacacggcgtttcaccgggcagcgtcaaacttatatcagggacaccggttatagtttgaacgatgttgtcctgcaacactctcagtcttgtaccaagcccaagtttcaagttaccgcgaaggtttggcgatgcagtaatgaaaatgttccatggtttctttgctggattatcatccggcaaaacttcaaacttagtaacaaggtccgcctcttcttggctgagaagatcataaacaccacccagacttaccttaccggtatactccttgcatgtaagtacatacagcaccaatgcagtcaaaaggttttcttcgccgtttgcgtaaatctcatcgccaccgccattggggttcgacgtattatcaatgataatatgacagaaacgctgcgcttcgataccaatttgcgctgaaccctttaactctgcgaggcaatcccaagaatcactgccttgcagataggagaggttaagtatctttactgtataaccacgttcttctgcgtatcttgcagtatcggaataaagttcgcctttcgggtccgtaatgataattgactctttgcgcttaatcgcttgaagaatagaaggtcgagcaaaacagtaactcttaccacaaccactggaaccaacgaccatgatgtgtttatttgtattgcttttgaatttctctcgcacgggcttcactgtgccgtcaggctttttctcaactgccattcgaccaagcgcatcgtatttgtagtgtcttccgtctggagagatacttacgatgtctcccttcttattcgggtctgttgacggaatacgacctacgattacaccgctcgttctttcgagaggttcaacctctaagtattctttgatgtcttcttctttcatcaggcgtgacgtaccgtatgttccgctgttttccatcttgaagccgcgctcatcatcttcggtatccatcatcgtcttgtccttccacttcatcataacgaacataccgataagtgcgtaaagcataagcggagccattaagctatggggtaggtttttgaaaaagaagattgcgcatgtaattggatttatggtgaatgaaaacgaagatgtatcatcaccaaatggcgtcaatatactcgacaggtcggagaactgcccgaatataccgccaatccaaatagtagcgagtatgccgattatcaaatagataactacttttttctgattacgcataacccttttacgtatctgcgcaatcatgctgggacgcgccattataaaacgtcctcccttccaaagataaattgattgatcttatttgtgctaagagcacgaatttttatttcagggaaattggtaaagaacaatcgcacgaaaggaacttgttccacgtcacacacaatgccgacgccgctcatgttctctgcatgctgttctcgaatgcgaatgagtgaagaaatgttacttgaaacaaattcgtagcagatcaaacctttgataatcgcatctcctactccttgctcctgcgctgctttcatttcatcggcggtgaaacacattcttttgaattgatcattcgagaagttgagcaaacgctttaatgttacacaaccgaaccgcatcatcgggatatagtaaaacgggattcttattcccttctttcccttacacggcaacagatttccgatgtagttgtttttctctgtgctttcgatcaaccgcatcatgttcgagtcatcaggaacaagcaagattgctctttggatttcctcaacgtgcgcataaacggaatacatgctttgcttcagcagctccagcgtttccaattcgcacatccggttcatcaccatcgtgtctccgcagcatgcgtaggtgattgccgacccggcatcgctgaaaatcacgccacttgcgcgtgacatgttcgtccggctttcacgttgttgatcttctctcaactccctcagcgaataaaacgtattcactttccgcgaaagcgttactccggaaatcttagtttccgccaaacttggcttatctgtgccgatcgagcatcctgccacttccagcatcgccgtcacatatccgagccggcggtaaatatctttatgcctttgagttcgtcctgggtttccaaagtaattcttgtagaaagagaacatcttctgatcttgctctcttaagaatgtttctccccgaagagtcaacgcatatgatttgaagtctgctgacttcgactcttttacaatcttctcttccgttaattctcttaggcacttcctgacgtaggtagggctttcgtgcaaaagcaagaacgtccttttgtctactcggtgagaaaacgcaagcactctcaatatggaccctttcaaactatgagtcattcagccattttcgcctcccattttgtatacgctaccgataccctgtacaaaatccgagtcgtccggccctcgaaaaaccccgtgttttctaaggattttacccttcggcagcaggtactttttgcgggtttcgttcagttcaaaaacgaacctcagaaatttaccttataatgccatttcgagtttgttattcggaccacaaatcacggaataattgcagttctttatgttgacaaatccactcttttaaatgcgatttttccacgacataaagtgcagaatacgtggcctgtgccggttgcgtcagataaaaattgtcgcaataacaagcggcatcgtctatgcaaattcgagggattataatgtccaggagccttttgatcgcaatattatcgttgtcataataaagtgactttccgttgtgcgacggtgaaacatagctcacaaaaatgacagcagcttgctctattttcttgtccaccacaggtaatttgtcgtgaatttgaaagagaattccgtccatcaaaagtgagccatacttggttctcgagactgcttttttcagtaaaggggggctgctgatggtacaacttagtcccaatgttttgtcgtactcaacacaaatatcaggaactaagaacgaattattgtcaaagacatgtgccttttgaagcgcttgtatttgctccttttcgtccggaattttaagcaaacaatcctcgattgagagcagtacatccacgcttttttgatacgcagattccatagcaccaatggtttcttctgggcaattatcctccattgaccatgaggtgtttttcaaaattgaaaggcactccctgcattttttctctgcattgaggagtgcctctttcgattctttatgcatgataaacagctcctgttgcttatactttcgagaaatatagcgatgcgatattgcctccgtttggatattcgaccactgcttttaacgtaggtacatccaaaacaatcggtgatctcagcattaaatctcgagaggaataaacgaggatgaaccgatccggaatctgttcagctgcatacggattttgatactcgtgcatttcagccactaatgatttaatctgaccatagtctaagctaccatcagaatcacatcgaacgatatgataaagtgcattgtttctttggaacgaaacctgtgccggctctggaccatcaatgacgctttccatgtccattccttcaacgaactcgaggaaaacccagaaagcatcttgcataaaacggtgcttgccgcgatccacataaccagttacgatttcttttttgatggtaatgtatcgacgtttctccatttcagaaaggagaaattctcggaaatattcctcggatatcatcagttcattctgtttgcaaatctgagaacaccgcttatataacgatggaattgacagaggcccgaatacttggagcattctcaaaacctcgtaagtcagctcatcgtgacatgcaagttttttgaaccttctcttttgcatcgtcatgtggagcttcccccctcattgcgtttccgccaaacatcggggttaacaaatcgcaattcaggcacccactgtttgttgtatttgatcgtacagaacagggttggagacttcaaaagatacggcgcattcatgatatcttctctgttatcgaaaataaagaagtaacggtcttctctcttaaactcaggatgtctcttgttgtagcgattaacttttacttcttgctgacacgccgtaccgagttcaactgcaccgtttcccttacaacgaatgataacgtaatgctttccgttcttcgtatacgccaggcttccttgttcagccggcttataaacagtttgaaggtcaacgccctgcatgtgctccatgaacacccaaaacgcatctatacccttctggttgatgcgcataatcgggttattcgagtacaggtgctgcgtagtttgataaacaaaaccttgctggcgcaggtttctcataatgacatttgttccgaaattatcggaaactttctggccatgaagtattgcaaacttctgtgcaaacacgttaattgccgcagcaggcagcgtgtcgcatacctgcagcatatggcaaagagctccttccagcgtgtccacatcagaactgggctggcggatgatgttcataaatatcgtcctcatttccgttagaatttagtgtgtcgttgaacgattcattagctgacggcttgtttgcgggagaagatttcggcggacggcttgccgcttttttgtggggttgctcctgaatctcattcttcatttccacaaaaaccgaagcctcatctgaatcatcttgatatgtgggattaaccagaatggtctgattttcgaagttatcaatcgtaccatccggatttttcacaaccgctccctcggccatttgatccattgccaggctgctcatcttggcttcgtatgccaactgctcctcatttttgggagcggcaggagtagatgcacgagggatttttttctccgcaggctcactcatttcatagtcaacatgtgagtcatcggttacgatcttatccagaggagtagcagtttcattgatggaggatcccaccagatttgctcttttctcttctttagcattctgttcttcctgctcttgcataatacgttcggcttttttacgctttacaatagctgcgatctgagctggatcagtcgtaatcaactcatcttccaaacgagaggctcgaatgaataccggaaccttattgttgtttgcacagataagaccttcgcctcgattgaagttaataatactgcgaacctcattcttggtaagctgcaatacgtcttgcattgcttttgcctcttgtgcttcaaggccaaggatgatttttgtcttcgagttcgagatgatagccttgccgtatttaccatcttggaaagcaaacaagtccgaaatatcctgcgttgcgaaaatcgcagatccaccgtaaccacgaatgattttaaagatacggtaaacgaaatctgctgctctcgaatcactggatgcaccaatcagctgccatccctcatcgatgataactgctttacgctcagtacggttttgcttaatgcgcgtccacaggaagtccataacgataaacatacctacggccttcatagtgccctgcagatcttccagatcgaaaacaatgaacttattttcgagatcaacattggtttggtggttaaagctggacgccgaaccggtaacaaaacggccaagaatatgggctacacgatgtgtgtattcgttctgttgaagcgtattatacaagtcgccaatgataggcataggctttactgttttggtcccaggaacatagatagaagcattatcgtgagtgataccaaactggttatacgtcttaatgatggcttcatcgacaagctgttcttcctcgtttgtcagatcaggaacgagaatatggaagaaggtaagcatctgtgacgtcttctgtgtcagccaactcttctgttcaaagctatcctgctcatccaggtattctgaaatcggagatactaccggtcggatctccataatgttaatacagctctttgcaccagggcttatactgatatagctacccccgatgtgagtgcaaacacgctgcatctcgtgggctttatccggcgtaatgatgaatgtctgaatgccctgatagcggaagcgcaaagccataagcagcgtacagtatgtcttgccagcaccagtggttcctgtaaccgtgatattcgcattcttgtacttttttgtgttgaaaatatccatgtttacgaccgaagaatagcggcggttgacgcccagcacaatgccgttctcatcacagatctcgcaagaagtaaatgggaacatacttgccaaaccgtatgtcataatatttctttgagcgaaatcgcacagttcttttttctcctgaagcagcggagctgtaacttgaaatgcatcttcagtacggaatactatttccttaatcgtaatatcacgggaatacagataatccgaaatgctttcctttcttctcagaagttcatcataagtatctgcagcaatcgtgacgaaggtgtacatattgtaaaagtcttcaccatttgaaatgctctgcttaatatattgcgcagccgaaattgcttctgcgatggactcgaaatctgtatctgtatcactacggttgctagccttaattcgcgtcagtttgagttttaaggccaccttgtctttgaccttacctctatcttgcttacgagcaataatgtctatatcaacgccgtctccggcttctacgagggttgtaaaccaaccaccgacaactgcagacggatagccattacgcggaatgaaaaagaacgaaagatactgaccatcgcaaatgacaaaattcttatgcgaaaaatcaacacctcgtggagcgatataatcaactataggaaccgccggatatgggtctactcccttcgtcagtccctttactttcatcgtgtcttcagtgactcgaataacacgttcagcaagagattcctttacactgctcctgcgattgtaaaactggtacagtgcttctgcctggaagtagtcatcatctttaggaataataacttcactgccacaagcaccaacaccgctacggatttttcgaacggcttcggcgatatcatcggcgatatcatcgatggtcttcttgcgcgtgctgttattttcgtactcaaagatgataaaaaaccgacgagcaagggcttcttgaccactcaattcttggatgaatctaatatgatcttgcgtcaattctctacatttaggttgcgtctcagtttcagcagccttcataatattacgaataatattcgtactatccgcgcgtctggtgatcaccttgaactgaatattagaaggagcaatacgcagccaacttgcaaacagatgaatgatattgtcttgttcttctaccgatttcagggtaaagttcgtcggtaaaacttctacgatttttatatatcggtcgtcatctgtaataatcatgccgcgataaatatctttgattgggataattgactgtgaaggaacaatgggaataggcttttcttcctgttgttccattgttttcttttctgtatccaatccttctgcctcaggagacacatctttaggcttgcccttaaagaacttgctgcgtttcttaggtttactgcgtttagctgtacgcatttatacaaacctccatttcatttttgatttcgtacaggaacccattgtggccatcgctatggtattttagtagaacgaaattgcaacttagccagtgctctcgtccatcccagatatatcgttttcttccataatgagccttctcttcaacataaaaatccatagaaaagacaaaaagatcttatccatggatttattctcatcgttcggattatatgtcgtcgtcctcgtcatctcccaattctagcttctgcagtaatacttcacgcatagccgacttcatccacaccgactccgccttcggtttcttctggcgcggaggcttagcctttttaatgggtgcttgtagtgcagtatccaccgcttgattcttcttcaccggctttaattttttcggtttaaccggtttaagttgttttttctttttcggtgtttttgcaaaaatagatttacgtggtacatccgagggaacctctgcggatgtttctgtttcagggatagacggaatatcattagtccctacaatatcatcttcctgatagtcgtcgatattttcatcttcaaactcgttcttaaccgcagtaccatttttaatagcctctctatattttttcatttttagaaaagttcctttgaacccctcagatgcaatactgtcgagaatgccattaagagaccaaaatgcagtgtcatatgcgaccattttatcagtaaactccacatagctgagtttacgacgttttcgaataaatcgaatatatgccataagtatttgagataaactctctccacctataccaaaggctgccaaggccgctaaaggtacaatcgtgaacatcatagtaataagtccgaattgtagaccaacatgcaggaactcaaaaaaaactttgtattccactattcccaaaggaccacataggacaaccatttcgattgcattccgtgttgagaaatgtccacctaatacaccaccagcatcatcaaagttttccggaatgtagtacacttccggccgaatttcttcgtctgccatttatctcacctcccagtttgtcaattcacatttgttacaatacatttcgtattggcccagtcagaatagcccaaataagaaaagttttccgtagttgaaccttttataaacgcagggtataaataaatagtatataagccatactgtttggccgtagctgcatcataacaaggggttactgcaaaaatagggtatatatctgaatcgagtacatctgccgatatagcctttccctgctccccccggttaaggacataagtggtatatgctgcaaaatctaattgttcaacaacatatctctttgcttctggaatggcaggataacgattgtgaacagagtaatcttttgttccatccgatttggtaatagatgcgatactccaaccatcattgttcaattcttcaacagcagtcttacacatttctgttctatatgaagaatattcaccgttcgttacatccaaagaccgagcttcctttaagtagcacttcccttcgtcattgatgccaacgcgcacataaaaagcgtctaagaacgctttattagtaagatctacagttcgtattagtacgcgatcatctgtatctccactcttaatacgcgccatagtgttattgtttatagccaatgcaacgccatattggtctgcacttttgaaggaaatatcaaacaaagtgctatctgtccactcgtctataccgaaagatttaacataaggattagatgaattcacatattctatttcataagaatttgcgtaagccaaagcaccttctgttgctgtaagttgaaaccctatcttcttatcagtggcgtcagattttggagataacggaatacccataccatcctctagttcaaccagttcatcgtatccaagagtgtaagtaatgccactttcacccgtataggttatagtagacggctgcagaaaatctctatccaaggtatgaatattctcggttgaaatctcatcaatactctcatcgttgtttttttgcccaaaatgtccaattatagaagatgcaataatcaaaactgcaataactgcaagaaacatgaagacccccttttggggggtaatcgattgtttgttcataataacactccaatctttttagacaattattttaccaaatatccatatccgccattgccgtaatattctacccagctctcccacgactggacttgtgcataagatcctagccaagatgtaacttgaccgttgcctatatatattccgatatgttgatacatttctcttgacccatatgcattatgataattttcaggattgctaccggccgaacctttatttatatatacctttggattggagaaaacagctgcaccaagcggtatttctttccatgacttgggtattttttgagctgtaaggaacctagcatgtcccgcacaacaaatgtcagtataggtattttttacgcccgagttaacgtaaacattttgaacccacttcaagcattctttgctaccagctccattggaagccccttgctttgcacgagcaactactttttgagccagcgcagtggaaagcgagccctttccgcctattcccataacgccgccaccagcatcccattccttttgtagggcaagggcagtatttttttcgcttcggtatctggttgcgtattcggactcattggttattcgccaatcataaacttttttcaaaaagtccatatccgatagcttgttcaattctgcagctgtacctactcgacttaattttcttggcggtgtcgcaggtccccattgaaatgcccaaccaagcattagcccttttacaacatcggaacgagaatctatcttatatccttttttctcaagagcatttacgacgggatcaaggtaatttgccgccgcatattccttctgaagacttttgaacccttcagggtcagctgcataagcagccttccaaatagttggcatcgtatcgctactcgagtgtgcatataaagattgcttgctaactgatagatatggcttaaacatagcgtatgttgttgcatcctgttggacgcaatacctcataaactcttgcaaagaaccttgatataagtcgtattgcaggccatatgcttgtccgcccttgctatcgttttgggtgaaataccaaaatgcttcgtcattggtttttccggtctcgtattcaatccagtaccacatagcaccaaaatagccgaggccgtcatcgccataacacgaggaaccacctaagccgatagaatcgacccatgactcgttcgggaaaagcatatgaccgagtgtagcggccatctcattaagagtatcacgataagtaacgccttcttctgttgaactattggaagtacctgttgtatcatcgccaaatgtaataccagcggaattcttcgccacatacacatcgttgtaggtagttactgtttctgctgtatgatgatctggtacgagcaaatcaatgatatgtccttttattgcaccgcccgtatcctgagctttacgccaaccaatgcctttgatataaaccgcgcttcccaatggaataacattcggatccaccgcaatggtcacaccgggctggagcggctctccattggcagcaaggcctgagttattaccattttcttcgacgcatggacaatatcgtgtaatcttaaaattgcccagcgaggtgcacttctcagccaaatatgagtcgtctattgttgtggtcggagatagagttcccgatattacattgttcaaaatgttatcgttactccctatcgtggctgtgccagtggtagcagtggctgcgctatctgtagatgtaagggtcgaggcttttgtcgttgacttacctatactggaagtatcttcataaatagaatcaagggtaacgccatccggcaaaattgccttttctatcagttcgtctacatccagatcatatacgatcggaaatacatatgttacttgcgcaaggccttcgcctcttacttctttcctgatctcgccgtttgaatctctttcgaaatctgaaccatacatcagatttccataagggtgcgtagaatttcttgtcgtccttgcctttaccagcatattggttaggtcattataggccgttaagccttctacctgatctgtgtcattgccctgatagtatttaaatgcatcatctcccaatccgttctttgtggatacagaatatccgctgtatataagcaccatgttctgattatccgtctgttctgagggtgctgtatagttggacgtatcgagtttccaaccgtttctctgtgcctctcgggacagatcgttatatgcagccgtcttgccctggtctagctgatcaatgatcatcttacggcattcatcggccttgttttccatttctttatagctatcttcagaattcttgttatccgagaagtctacaccagaagacactgattcagggtcattctgatgcaaaagtgaattactgattaagctgggcataaaataaagcagtcctccgaagaagactgctatacctaagcctgctgcaatatataatttgataggcagcggtatcattgcgaataatttcttcgcacccttggccgccgccttgcccgtcttagctgctttcttggctgtaccgactgtcttcttggcagtacgacctgcttttttagcgctgtttgcagcgtcttttactccagaatagctatcttgtagcccctgttgtagatcgttgttaggcacgaatatatcacttctttcgtttggtataaaaatagaagaggcatgataagcctctcctattctaagagttaattaagagcttgtgttacaatgacttgctattttaccgacttattctccgggaccaagttgaggatgattgcctcctgcgatattagcacgatgttgtgccgcacgatacataggcggtttcgtaggagcactatggtgcggtgcatttgaattggtaattggcatttttgccgttgcaaaaacgccatgtgcccgcgcattattatccagcgaaacagctctcttgctaagctgtcctcctcccatttgatcagcagcaacaagtttatattcagcgccagttgatgatgcatacattgtttttacattttgcgcactagcaggaacatcccacaaagcagaagatactgccgcatattgctgcccgttgatatccatggtgaatgcgcccaaggagcgctgttgcacattggatacatcgcccattgatagaatctcgttgaaatcatatgcaggatttgccgctgtagaaaccgccgggcctgtcgaggcggctgtaatatcagaaacattatagctcatatcgccaatctgttcagtggacgaattaagtgctgcatcagctccatacatacttgcgctggaatattccttcgcctcaataacattacccgcatcatcggtacgtgttgtttgccaaacgccaggtgctacttgttcagcagagcaattctcctgctgattgaagtctgccatagccttttccatagcggggttgtaagaattaaaggcatctgcaccatcacctgtagcggcggcaaacatttgaagttgattaccgtcaccatccgtcattgtaaacgtgcgaccttgcagctgatccgttgcaacatttgaatgccccatcaaatccggatcaagcgttgcaacatctatatctgctacttgtccggtctttgggtctctccatttcatgctaaaagtaccgtcttcacgcgttttgaaagacgttttctctatacccttagcaaaatcagatccatccaagctggaatgttttataaagctatcggctgctttcataccatttagcttagacaattcatcattcacaatgtttttatccattgcattcttgaacgaacctgcggaaatattgccatttttgtcagtatagacatgactttctgcctcacgtttccgtagagcttcatcaagcttttcacctgcagctttatgttcagcctccgcagttctacgatcttctcgtgtctgtttaaacttatcccatgctgcatggtttaccttcgactgcaatttcttaaccggagctaatgcgcgacggacacccatagcagaagctaccatcgcaccggcgagacctcggccggtctgagcagcactaaggccgagcgtattaagatagctatccacgcgagttgcaactgcaaggatgccatgcatcatcaacacccatacaatgacaactgtacctaaattataatttgccattataccggctttcgctgctgtttgttgtttatatgtttccaataagccatcatagctattcagtcccatcataaacaatcggaagaatataacattgcaaagcataaggaacaactggctgcctatcatacgcacccaggaaccaaaaatattacttgttgacttgcttcctaacatagaaaatgcaaatggacatgtgtaataaaggacgcccaacacgatgtatcgttctgccatttcaataaggtacataataaactgataagccagcataagcaagaggaaaagcgttagcaagagcgcacctattgaacctgctgtacttgtaggcccaccagcagaatctccacttgccagtgctgtagtcatgttatcagatattcccgagaagtctattgccgcttcggtagcctctgacagttttgcatttagaagagctccgtatataatattaaagaaatcctcaaaaatgtaaattatttgctgacctgcgtatattaggcagccagctatgattgtccacgctgtaaggcttaacggtgtatcattactgccctgagacaagaacatcatcttgcttaattgccaaacataattgattaaaaggaatgctatggcaatgataacaaagtattgataaaaatttccgatggaagaaaaaactaaatcgaaaaaagatttaccactacctacgttcattgttaataatccaagtatactgtttccgaacgtatcagctatgtacgcggttgcatctacaaggagattaacgagtttttctacaaaccaatccaaaactaactatcccccttttcctttctgtaagcagttctagctatattggaagcaaaatcagggtttatcttgctatgttgcaatgcttctatcaaagcattatccaaatcaatctttcgagcaaatgtagtggttccctgtgcagcacgaggaataaacactttatttatagattcctcttcaaaattatttactctggccataatatagcctgcgccattattagcataggcatgtgataactgagtatctgtctctgcttgttgactgattgcagtagataagataggacacataacgaacttttctccgtccttttccaggtgtacttgatctgcactacctcctaccatcttataaccatctaaccccacatctgtaaattgtgaattaagccaattttgcatgcttgaaggatcagatggtgcatatgtatcttcacatgtagcaatggtatgtccagtataatcttgagctgcgcaaacatcatatgtccaataatccatgtctcctactcgggttttcacagcgttcaggctcgcatctggcgtatagctacatgccggtacccattctgttatcattttcagaccagcatcgttggtatatgttgtacgatatgcaccagttggtccatcatctgactggatacgctgtacttgccccttgccccagccaataccatatttctcttcgaagactgcttctgctgcactgctccgcgacaaatattcctgcgcttttgctccctgcgcaaacagaacaaaatcaccttgcgaaggtatgctgatttcacgaccaccataggcagctgtaaagccacctgggagattttgttttggtatcattgcgattgtaagggagtctccgtctttatctttaaccgtactcaacaccgcagcgccaccttttgttatgccaaatgcacccttttcaaatctttcggatttgagttttgagtcacccaatgcattcagcaaagcatccgcagcggcagctgcttctttggggttctcaaaaagagcgcctttcccttgcttatttttcattgcgtcagcaacatttgcaaaatccgcgaaattctttttaactgggttcactgtaagaggctctggcgattgggggccagcaggtttcccgggcctgttcgctagacgatgagtcatcctgctaagaaggccacccggtttaccacttttctgtattccagaacttactggattgattagtccgatatcaatagcatccatgaccatagaagccatcatacccgcacctgtctccgctgtactaaagcccatcgtattaagatagctgtcaaattggcctgctacatacagtaatccgtattcaacaatacaccatgtaatgactattgctaccttggaggatgaactgttctctgctccgattgcagtaattgcatttgaaaatccgcctacggattttaaaaataatgcaaggaagaaaacattcataagcatcagaaataaagtcgatgcaatcatacggatatatgccttaaaggaattacgcattgatttggtcgtgataaaacaacacgccagagggctgaatattagcaatgctcccagcaccaaatatctttgagccacttccagaataaatccgaaaaatttagcagcaatcatcagaagcaagattaacagtagaaccgatgtcattaagccttccatgagggctccatattttgatgccgaaccatctgctataaaaacagttgccgagcttgcaaaattttgaaaattcgtttctgcgggcaccatcttcaggagtccagagtaaagaaccataaagagtttttcagcttgcacaaccagaaacggtgcacaagtggacagaatgcccgcgataatagctcctgtaattacagacatcggtgtttcattggcctgcgggttgataatgatctttgataaagaggatatgaggataatcataataaacgctattgacagcgttcgtaaaaaaggaataatgcctgaatatccttttagcaccagctcaaacatgctgccgcctgttccgatatccggtctaaaaagcaataccgcactattagcgatggttgtcatcatgtagcaaacagcatttgttatgacatccacaatagctgcgacaaatgatacaagaggtaaaacctctaatgccgcaatgaaatccaaaactgagccaaaaaattcaacgatactttttacgccatcagcaaaccaagcggccgcagtagttataccatcccagactttgtcccaaacatgttgtgctttagcaaagatagaagaagcaaaagctcgaatactaaacaatgcaagagagtgcggcttattgaaatgaaaaaaaactttcaaatcatgccctttctgggggaatatcccccgttcatattttcatataaagagattcaccctcgcaacgtagaggagaacgcgcgagggtgccttcaaatcacattttattggggattattccgaaacctttgcttttccgttagtgagggtattcaaatccttattcatgccactagtagcaccttgaacaatcttaaagattaaacctacacagttgaggccaatataacatacgataatacgaacaatccagtcggttgcctgtgctgccttttgtggattgcctgccatacgtacggcaaaagcgatcaacagcgccaatgcagcagcagctgtaataacaccgtatgccgtcttaaaaatagagttaatggaattgccaatttgcgaaccaaacgatgaaagattcgggcttgccgcgaatgcataagtagtcagtccagccattacgccaactgtagaagaaacgccgaatgtcttccgcatcaaggacttatgcttctgaattgaaatttggaaatcaatcatctggctttccagcgctttttgacagcgcgaaaggattttagacatttcaatcctcccctttcttaaaattgagttttgaacctgtctcatgtgaaaaagatactcctctatctcctagtcccatgaaaacaggctcatataaacacattatttgtttgatgtgcttatatgagcctgctttgctttccagatacaaaaatcgattgaggaaacaaaaagagcatgtaaaacatgctctttcgcctacttacagtttttcatactataattataacacattatttttgatatacaattaccgacttgttctattttgttctacttgtgttctacttgtgttctcattttatataaaaaatcggtataccctataacagatataccgatcgtatgtttaaaaatgcttcaccatgtctatgctaacttcgtcatcaaacatttgccgcaagtacgataagatttgagtcaattcagcctgattattagcatatccaaagatattcttcgtcagttccttctcagcgttcttcattcttccgtaatagacggccacgccgccgtagtggaatttcttcatcgtttctcgaacagccggcttgcgttcgcctgaaatataaacaaagtccaacagcctgcaggcctcgggatcttctttttcaagcatgcgcatccccaagcgaacagcatctaatgcagcgctgagcctacgtcccgttgcaatctgaggtctgtatgtcctttcaaaacgctgctcctcgctgacactcatcaattccaagcgagatgacagttgctcaaagaaacgagttccctcttcccccgcagttgtatcctgacgtatcttctctttgaaatcctctaggaaaacctcgtaatcgcttactaaatggcgatacatcttcagaagactatgaacgttcttatagttctcttgtctttcgatttgtatgcgtactgccttggcgtgatcaggaatgtctgcgtccacaataacaccagctcgttccaaatactcacggatcatgttttcagcctcggatttttttatttctttggctgcattactttgtgggccatccttctgcatctctgctcccccctgtaatcacataagttcttatttgccattttacaatgaataattaaatgctcttttatattattcgtacaatatatttgcattttgaattatacagttatgctttgaatatgtcaagtataagggtagaacaaaacaggaatgtttgctgttcttttcatttttatttctgtactatattacaatctgaatatttgtgtacttaatatattgtggatactttgttttatctctacacagtcatattttctttgtaaataaaagggaagagaccttagcagcctctccccttctcttctgtgaatttttttcgcatcgccataaatggttcagatgtaacatagtcatccaatcctttataggttgaatcccattgcaatgtactatgttcataaccagcatcatcgagcatagacctcaatcgatctagttgctttgcaacctccttattggtggctgcatccatatcataggcaatgtatatcttccgcatgccaatgctttttagctctcgcactacctgaggaacattcttaagagcatttacgcccggaacagcaattacatttactcctgtaattgcattcacaatatatgctttcaatggcccttctataagaatcacatcaaatgggtcaaaatgaccaacttggacattttgtttttttgcctcaccaactttggcaattcgatctgtgtaatcctctcctgcccagttaatccatggctggcacgctgtaccaccagtatagttcttactcgaaagatacccgtatttcgggatatgtcgattatcgcttgggtggtcatagcgaacctgaaaaccctggatcattccatatgcattgcgcagaggaataagaaacccatcatctactactttagaaagagtccattttccgttttttgcaatgcaaaatcctggaacgccctccaatttgtatccagatgtagacaatcggttcgccattccgagtgaatcaatggttcggcgcagagatttaaaacctatacggtcgatatcttcatcgctgagtcccctgccccgcagatctgagcggtgcttttcactcaaagtcataaaacttaacatcttattatatgtctcgttttttactcgaatgggggcatgaacattgctgtcatccgacaaatcattttctgccttatcagaaatgatactggtaggtgtaaaagaaccaagttggccagcttttactctttcaacaacttctgaataaggccaatgcgtatatgccgcaatgaacttatatactccgcctcggaaatcgcagcgattacatccgaacacgttctttgcgaaatccaaattgagtgttcttcttttggtccggtgctgcggagaacacatcggacacataatgtcggcggttttgcggtttgtatcgactagagggccatcatttaggtcaatgtggattcctaagcgtcggacagcttcgcttagactgataatgctttctgtgcccacaacacaatatcccctttctaaaaatatatcccagaaagcaaacgctctctgggatatattataacatatttaactaaatgtccaagttggtcatttagttattacttgtctttctctgccttcagagcttccagctcttccttgaaccgctcctgcagatcatcggcgttgataacacccttacgcaggccgtcttcgattgtcatgatcgacttcagacctgcttcgttcaggaacgtgcggctctcaccacgcgccagttttttgacgatgttccgtgcgatggacgggcagtccagaaccagaacacccagaggcttctcgctgtacagtgcccaacgagataccatgccgttcttttcgtcgcctgcctttaaatcagcagcgtacgacggctccagttcacacagaacctgcgcagcttccagaactgcttcacgagtcagttcatcagaaggggcagcgtcttccgtgggatgttcaacatgagcctctgcaacgagttccggcttagtttcttcaaccggttcgtccgtttcaaccggagtagaagatgtcttagcagcttctgcggtgtccggaataggagagaatgcctctgccgatacgtcttctgctacgaccgattcggtctcagccggcgcactagtcggcacgctttccggctcaaccggagacatctcaatctgccccggaagcgggtccagatgttctacagattcctccgacggatcaaccgcagtctttttcttgcgaccacggcgcttaatcggagcttcctgtgctggcttaaccaaatctgcagtttcgccatcatcagcttcttcagaggcagcggacgaaaccggtgcaacaacaggcttcgctccgccggctaagtatgccagcatatcctgcacagcctgagtctgaacctcacgtacatctttctccgaaatagcggacagccgctctaccgaggcttcttcaccatcctgcatgagcatggccatctttaccagtacatactgatcattaaactcctcgatggatgcgttgattctcttaatgttcattatattactcctttttttataatatgcggtgaatgtccaacttggttatttgcgtgttttgcaacacctccaaataagaaatttatatataaaaatatgccaagaagaatataaatcttcttggcatatgaaatcgtaaaaataaacagtgaaggggaaaccttcgaaacaaactttcagcacggagctgatagagggactttatgagtatagtataaatgcaaaccggaattaagtcaagaggggagcgataaaatacgatgtgaaaatataactttacaaacacacaagcaaatgttcaacttggttgtttgagaaggggaggggatcagagagcaatgtccaagttggttgtcaaagcaggagagaggaagtatggttgaataaccaagttggttatttttatgctttcttaagaataattcaatttcacgaaggcataacatatatatcagaaacgtagggcagggtaggaattcatataaatagtgaatatccaagttggttattttactttttagcaggtaaggcaaccgccctcgacactctatgatatttcctatttacaatttttcaacgagttagtgaatgatttgtattgacacttatatgcagcagtgatataatgaactcacaaacaagagcaacaaacatctatacaaggggtgagtaccattaaaatcattactattgtaagctacaagggtggaaccggtaaaacaaccaccgccaagaatatggcgactatccttgctcaaaagtatgacgcgaaggtactgtgcatcgatcttgatgccagtggtaacctttcctcctactttggctgcaaaaaggaagaagatcagctgtgtgggctgcatcgcttgcttttggacagcaatgttagcgcatctgatgttatccaacacaccaaatacgccaacattgacattatcgactccaatgacacggttacaaaagccgatattgcaatgaaatcggattatgtatcaccgcagcagttccacctgcgcgacaaactgcagtctattcaggatcaatatgactacgttatcatggattctcctccgactgaaaatctggtcgtaatcaatgctatggctgcttcaagggatctgattgctccgtgcaatgtggaacaagattcttataatggcgtttttagagttgtaaaagcagtctctaatgtgcgccagtacaatcctgcattaacatttcgtggtatcttgcttacgcaaatccagcgaaatagcaccgataagcagggtgttgaaaaaggtattgctgatcttccgaaattcaacacctatatccggcattccgtacaggtcaagaacgcgaacttcaatcgtcttactttagctgaacaggataaaaactgcaagccggtaaaggattatgagaattttgttgccgaataccttggattgccggctgtgcacccagaagcgccgtatgtaaaaaagaaaatgttcaacttgggcattcgctaactaaaggaatagtagaggtgatattgtggctaagaaagtaaatgtaatggcagcgttggaagtaaacaacgcttcacttcttaataagacatcgcagtctttggctattcagacggaccagatttactggcttccgcgtgagaaagtacatccccatcccgcagaggaaaatatctatgatacctcggagttttgtattccgaatgagacttctgccgatgactctatgggttccgatgtggatgatggcgagcataaagataaatatgctgaactgcgggcacttgcagaagatattgctcgtagaggcattcagactcctctgaaggtatacgctcgtgatgatggcgaatatgtactcattggcggtcatagacgtcgagcggccaacgaactcgctatcaaactctaccctgagtatcgtgaaaaaggaagcaaacttccttgtattatcaaaccggcttacgatcccaataagcaatatgaagccattgaggatatgattctggataacctccagagagaaaagtcggactatgataaggtccgtgaaactgcaatgtatcatgagtgcttgagccagcgtaagcagaatggcgaagatattaaaatccgccaaacaatcatcaagcacctcggtcgcagtgatagtgagattacccgacacctacttatcatgaaagaccttattccggggcttcttgaatatttcaagcaggaccttatagctcaaactgtagcctatgagattgcaaagaaggaagttccgttccagcgcttcctcctcgacgatagcacatgggataaacacacaaaattatctcttcgagatgttcgtatcattgaggataagtatcaggatgctttgcgagaagatgataccgaagatgcatccgtcgagccgttcaacgccgcaaatgatgatgactctacgatttccgagacgtccgactacgatgttgaagcagcggctggcgatgacattaccgatattcctgagcagcccccggtttccgtaaaggagcatcctcgtaaagtgccaattcgtgatattggttcgggcctgactatgatgaatacatcgctttcccgcatcaatacggttctgagcgaagataatctctcgaacctgaaaacacgagaaaaagataaaatcttgcggaaaattgaaaagcagacagcctctctcgcagcccttttagatgaacttgaggaattagggctggataagaaagaggtgatgagaaagcatggcgtataagcaagtctatttttccgcccgcttatccgaacagatgttaaaaggattggacaaggtttccgcacaaatagataattctacgcgtgcggaagttgcgtcatatttagtccaaaaatatttgcagcatccggttttttatgaaagtcgttcgattttagcattacgaatgcccctcatgcctcctctcgcttttcagataagtgaacattccttagaccgcttaaaagagatagcccaacaacataattcaagtgtggcagctatcgtccgaatcgctatttatgaagggttgatgtctcatgaaacgtcttaaagagaaggaagaattaaaaagactctctgtcaacgaacgtaatgactttgtagccgatgaacttcagcggttgatcagtgaaatgaccgaactccgagaagaaaatcgtctgtcgcaaaatcaagtatcagaaacgctgggattacagtctcatggaaatcttaccttgatagaacaaggcaaatcaattccacgactggatcgttttttaagaattttatctgtttacggctatacattggatatcgtatcatccgatgatgcatgaaaaaagaggaatgtccaacttggacattcctctttttcgattaacttacaacatgcctttaaggacaagggaattattcggtgaaaattttttcggagttgtgcttttagcgcttttttcagaattttccagagttttccaatgcgcgtaatacctcaccgaggcgggaacgcctgcagctcacctcctcagttaaaatagcagtttttgccgcttctggttgtcctatccagtacaaggtctgtttacaacggctcacagcagtataaatcagatttttcttaagcatggctttgtgatcttccataagaacaatgatgcaggttttgaactcgcacccttggctcttatggattgtaattgcatatgctaaatcgaaattacgaagagaactctttttgtagtcgtggactctaccatctccaaaatcaacagaaaaagtattatctgtcaactttgtgatatatccagtatcaccattcgctacgtcatccttgtttaccatggacatcaccttatcaccaaggtaaaaggttttatctttatactggatacaaggagtaccttctgcgataaactttttctggagcaaggggttaatctgattaacaccggtcaatgtgctgcgtcgatacgggctaagtaaacagatttcatcggccgtcagtccttttgccaattcagtgtcataggccttgaggaccatttcaacagccttttcttcggtatcgacctcctgaaacataaatgtatcagaaaactccaaatcggtattacctcgcttaattcttgcacagtttacggcaatcgtgctgcctgccttctgacggtaaaccgtcaccaactcagctatcggtactaccttactttctataagttcatacagaacattaccggctcctacagacgggagttgattcgtatctccaacgactaccacctgcgctcctgtttgaattgccttaaagagtgcaaagcaaacttgagcatctaacatggaggcttcatcaattaagattaggcctgctgtaattgaaacatccgacttcaaaacctctgctccagcagatacattcagagccttatgtactgtacaagcaggacgaccacacgattcggacatgcgtcgtgcagctttgccagtcggagccaccagcaaaatatctttatccggattgaacttttcaaatacctcaatgatgaactgttcaatcgtggtcttgccggtaccagggccgccaattaaaagagttactgcattggcgagtgcgactttgacagcatttctctgctctggagcaattcttagatgcttcttattttccagggcatagatagtatccttgtactctcgctgttccggtttgtacgacatcaaacgagcaacattctctgcgataccatactccgcatcacatgttgccttacggtagatatacttaccttgagcacacatgcagaacttttctttaatgcaggcgttaatagcatcgatgacgcgatgatctgttcgcagcagacctacttggcttgctacacacacgcacaattcatcaaccgtacaataggtgttgcctgttgcgctgccttgatcaaaagcacgtccagaagcactaccttcggactgtctcaacacatccactacagcagcctgaattcctttcggtgactgatgatcaatgccattctctttggcaattttccgcatcatctggtaaggcaaaaaaccctcgatacaaaaccgaaatggattttgctgaacctcctgtaatgaaaaagcagctagcgatgcattgcagcactcctccgccgatacgcttttgggcgccttttggcagagatacataaatatctctttcttgttgcgacgaatagaaaactcacgcaatactttttccgcaatgaagcggttctggacccactgtaatatctgcgatggatcgctatccaacttggtcattggttcctcggccggcagcttgtttgcaatctgcacagccgtctctttatcgcagccatctagtgtttccagaaaagacataacgccagaaatcgaatttggaatttcctctcgactattattgacattaagtacgagggaaccgtccttttcgaatgtccactcatcgccctctaaggtaatggtggattttttcgaataggggagtaaggtgccctttcccttaaatctcaagctggtcgcattctccggtaatccttccgaagaaaacgcttcatatccaacgaccatgaacccgatttcatcggcaggttctgccggatacaatttacgcaaagcacgacattttatttttatcatatcattctgagcacagacttcgtaacgtgcgactggcaaatgtccaagttggtcattcactaaatagtgaatatccaaattgaacaaaggccaggtacactacggtgctttcctccttttcagaaaatgatgacgctcgttgccgatggaattaaccacggaaacgagcgtctgatatatttagtccatccaatccggactctctaccttggtaacaccaaagtgagccggagtggatttatcaaatccactccaatcgcacatgagcagtcgtgcgagaagttctgcattctgcacacggcgaagcggagatttgacatccatcttgctaaatgcgttgttgatgtgattataaacatcaatcgcaaagcaggtcagatctttttcatccggcgagaagaatgcctcgaaatcatccagagtattctggagaaccgaagttgtcaccgcgctcttgaaaaatgcgagtgcatggctgcacgcattatacgggtgaaagatcttcaccttacagagcctctcaagccccataagacctctctgatacagcgcagcaatctgcgaaggaaattcttcgaatttaccccatacagattcatcgctgcctcgatgatttacacttaaagacgagccaaggtaaatcgttgtcccatctttaaacttcagtgtaggactaagggcaatggaggtgagccccgattcacccgtaataaatcggcaaattggctgggcttcttcaagcacttttcgatctccaccagcgctttcccatgcatccaggtaagcagaagaaatcgaggcagaaccttcaaactcggagtctgccattgcctttccaagagaccactcgcagcttgtgaaaatatggttgatctctcccttgcggaactccagatccttaaacaaagagccgagggtcatcatggcatactcacactgagtaagctgagaccagctggcattatactgtgagaaatagccaccgatcttaccgcctctgcgcatgaccatcaaatttttggtcaaatacggtgcgctcatattgagatgttcacacacctgcaagtaatgccctttggacagcatcgtcgccaaaattttggctccgtcacgatggtgctgcttaatggccttaaagataaaaggtcttacagcaaaagaagcaccatcgtactgcatcgcaatcggaagctctccactgatagagtccttaaagacatcctccgggattacatctgcaaggccgtgaatcggtgcaaaatgcacatccgaagccttgactaaatcccatgcggtgtccttgcagaaatccgccagggcaccatcaaaagcgccttcatcttcgaagaagagttccaattcatcttttacaaaatcgtacataaaattttcctcctgtgtttattttgtggataacagtaattcttgtgttttatcaaacctcttttctattattaagatgaccaacttggacattcatcgattcgtgagtgttcaagttgaaatatataaaaaagcaccactgtacagaaatacaatggtgcttgaataacataatgggggacattctccatatggagaaaataggatactttacgatttacaattaaatcgtacaaagagacttttctgttaatagaataacatttcttgtcgactttgtcaactctggaccttgaaataggcgggtccaaacgataactcaaccaattagcaaatgaccaacttggtcatttgcttttcttcgggaaatccaatgaatatttagcctttccgtcggtatcaaatgcaacacaaaggaccgcatcatacttcttctgcgttttttgagacacgcagcctttaagcggcgtctgatgctttgtcagcaggttctttaccatcgcggtagtaaagccctttttgcccagcgactgtaaaaacttattctctttccaaatggagaatgagcattcctgcgtagtacagaaaaaccccctgttcttctctattatgcgtccaccacaaagaggacactttccgattgcatccacttcattatcagaagcaaacttgtattggggaaaatcgccactgaaatctacaagcacttccgcgtcatatgttttgccgcttttagatgtaatattctttactttgagatgtttgctcttcagcataatggatattgcagccggagcaactggctttctcaaaacattggcaaagaatttgtcctctttgctgatatagaatttgcagtcctgcatcatgcacttgtatcctttagccgtttcgtaaacatcgccgccacacttggggcacttgccaagaggcgtgccaccaacgacacctgtcgaatatcggtccgcattctccatgcgtcctgcctttgagtcgatgatagcctgtactgtacgcagaacatctcttgccatttcttccggggtcatttccccttcttttatcttctgctgctcgtaccaccattttgcagatacatcaactttacggacagaatccggcaggacatcgtaaaactctcgtcccaactctgttgaaatcaagttcgtacgcttaccctttttttcttcatatagatatccagctttgataagctcccctatgattgcatgcctggtagccggagtgcctatcgaacccgactcgccttttttaccttggtctttttgcagaagaagcttctttacagtcggatgctgtacatacttcgcaatactgctcatatcagacagcagcgaagcctgtgtatatcttgcaggaggttttgtctcctgttcggatatggaagcattttttactgaaccattataattgccaactggaatggtactaagagcagatgctactgcttgctgattttcctcttcatcggattcttcatcttgggcatctaacaatactcgataaccctgatctaatacctttgaagaagtgctttgtaagctacctccatccgccgcaggtgttgccagctttgttacttccgattttaacggcggcataaactgtatgagatagaactttgcaatcgcctcataaaccttcctctcgttgcttgtaaatgtcgaaaggtcctgttttttatttgttgggataatagctgtgtgcgctgaaatgttggcgtcattaaaacacttgctttttatcgttgtatcgaactgtgtcgagtcaatttgcagattggcgcaaatcgtcggcagggtagagggggcctcatcaaaggtagcttcgccaaggtattgacaatcagacctattatatgtaatggctttgtgtttttcacgaaggttttgagtaatcttagcaacctctgtaggttggagatcccatttgcgagcgcagtattcgtataattttgtctgattgaagggaaggggaggggcagactttttgatctcgcgcgtaattgcaatatcaggtaaagaagcgccttctatttttgactttaacccttgcacatattccttatcaagaaacttgccatttgtcaaatgcggattatccgcacaggggacatagcgacaaggaacgtcgaccggtttacccacagccactgcaacggacgcattgatcgtataatacagcatcttcttgtggttttcgatcaggcgatcgcgctgtacaaccagtcccaatgtcggcattttgactcgaccagtaggcaacgtcttcttgccaccgttgatcagactgtaatagcgtgtcagattataaccgaatatcttgtcacacagctgccggccaaatgcagaaacaccatctctactgcgcagttcattcgggaccatgctctttaaagccttgcgcatagctacttctgatgtatcgttcgtattcaagcgcaggactttaccattgtaattatggaatgccagcagctcatcaacaagcagctgtccttcttcgtcaatatcgcctgcattaacgacggtatctgcatgctggagcagagcacctatttgcttcacacggtctgctttatccggctgcgccttatgcttccaatctggaaaataaaaagggatcgtttccattttccattctttcaaattggggtcataatcctccggatcccacaatgtcagcaaatgtccatagcaccatacaatggttgctggctcaccctcaaaagaagttgttattattcccttatgggtatcatactctttctttccggggatggctgctgcaattgatttgcccaaatccggtttctctgcaataaacaaaatcaacagaatcatcctcatttcttttcttatattataccacaacgcctttattgctgcaaatatatgcaaaaaacaccggccacagaaataattctgcggccggtgtccgttaaataatagcatcgggattaaagagttcaaacttcaaagtctgattgtctccatccactgtgatctgctgataaatatcacatcgattcatcagctccttagcaagatactctgcttccgtgatagtctgaatgccttcaggccacttgaaaacgaaagaactctctccgttctcaagagcagaattagccagctcttcgagttcccgagagataaagagtgcaatattttctgcactcatctttgcggtctccgtcgagatcggaggaacatcgtcaactgcgagaatgttctcatcgttgataggatcaatgtctcctcttacctcttctcgttcaggagcagtaagtaccgatgttttgccatctctttctattgcaccttcaatcttctcaggcgcaatgctcggagcagcggattttttctcttcggtagtagcggcagccggcgccggtgcagcatccggagtaaccaccttggtctctgtcggagctgccgcagcggctttaaccattgcttccgcaaccggctctgccttttcggccttcttggcagaacgtacaaggcgtaccttgacattctcaccaatcatgctgcttacgctgccgtccttgcggtaatgtacctttaccagcgcattatccaagccacgaacttcgctcgtaacagatagcaggtcttctcctgtccaagaccatacggcatctggcaggacttccttaaagaagctcgtaatcggggcgttctgctccttcatacgcttttccttcggataaagatacggcttgttcacgaagcgaacctgcgagccatcaatcatcgccattaccgcataaactcgctgattactatccatctggatcgtaccatgccagcgatttttatcatccattacgatgatatcgttaatagctacagcatcgggccagcaccagttatagccggtaccatgcattactgcatcgatgtccgggatgaggcacatgcgatcgcacgcaacatccacatcggggacgaccttctttacgggttcctgctctgcctttttcaggtgcttagaaactacaaaccaagtgccgccgagccagcccaaatagcacattgccgaaacaatggcatgcgccgaaaagagtaagctaacgaggcagttaaaaaggatggttactgcgcaccattttgcagctttaactgcggtttcatgtgtcataattgacattttcatttctccttttttatttgtggagggagctttgctccctcctgtttgtgtaaacttaccgaatgtaacgcttaacgagtgcaagcatctgttccgggagagtttcaagcgatgtgatatccaagaaacccgttccgaaaattcgatgaatattctccttatcactaccgattgcggcagtgaatatttttgctcccctgcgagagaggccgtttgcgatgttcgccatatctgcctccgccgcacgaccatgatatctggttgcgcacggtgcaccatcactgatgataaacaaaatctttgtcttctccggtcgcttcaggagatgctcaccagcgaaaagaatggcagcaccatctcggttatcctgctttgcttggatgttcagcagtctgtacttatccaacttatccggggtatcaaaatccgcataaatcgataactccagatcaccaacgccaaacttggaagtatgaccgattacagaacatgccaactcgcacttctcgcagaagctatacagcgcaatcgcagctgcacgggccatctcgattcgttttccacccatgctggcagattcatcaatcaggatggataccgcgattttgttgtctggcaatggggttgtagcatgtttgaacacgcgataatcattatagacaagtcgcgtagcatcaaacttactaccagagaaaaaacctgtcatatccatggcattgtcgccatcattcttacgaaggtatggcttgacccgccttgccatgatttcagcgattttttcgatagaccccattgtttcgttgtacgtactgattgctcgttcagagacattttttacacgcgatacgctagtagataagcctcggtgagccgcgccgtaatccaattcagaagattctttgctcaattctttagttaactcatcattaacttcagagacagctttctcttctttcatatctcgctcaatacgagacataacagaagaaatttcttcatcactgaaagactcttcgacctcagaaaatgtcgaagcaccttcgtcagcagggagttctacctcgccctcttcagtagatgtatcatctggtttatctgagtgtttaccagcggtagaatctcccggatccgcgtcttccgaagatccatcatccgtaccatcggcatcggactcgtctttatctttatcagaggaggagctatcaccgaagaggtcctcacttaactcggatctggacttgcgcgaaccagaagaaccagtatcttcatctttcgatactgctaccggacgaggagacgttccttcgccggaagtatccttactactggaacgcatatcaccggatgcctcgctatccatcgacgaatcatcatcaaccggcatcgaaaggagcttttccttaacgataggccaaagggtcaggaaagtaagatgaacacccagcaaacgacgtttggtgctggaggcataaaggatctgatcgacgtatcgacgagctttattgatccactcgacaggttcactatccctttcttctgggtttttcgtgtcgcatttcagcgtaccgaatttgccgtagcccagaagaagtgctgttacagcgtcatacatgaggaatttaccagatgcaagaccctccagaatatccttgagcggcatcatcgtatcgcgctggtacgctcgaaccgtatttaacccatcaatcaggatacccgacattacgcgatagaggcattcttcaatataacaatcctcgaggatgttataaatatcatgccacagcttggtgacattgccgaggcgatcgggattttcagagatatactctttcacttcctccacagcaattgtgcaatcatcatcgagttcttcagggagaaccgggaaccacttgttttcgcaaatggctctgatcgcggcatgagacccggccgtgtccgtgaaacggtaatgaccgaactcatgagttaaaacgccaatcagcattcgcgttttcagcgtccgggtttccagatgagtaatgatcggatgcaatgggttgaggtaaatcactctaccatccgtgcaacccaatgcctgaggctcatcttctggtgcctgcatattgactttcggcacccggcggcgaattgctttacaaggaatgcttaacagcgtttccatgtatgaaccaaatgccttcgatgtcagaatatcttcgtccttgatggacatatccctcattttttttgctactaatgcagcagaattcatacttcttcacctcctgatacaatcacagatgaatttcgagcagatatgctgcgattacgttctcccaaatagtgttttctgaatcattacaattcagtgcactctgataccgagccaccaacgtatcgagaatatagttcgtggactctgggtcaacggcgttttcgatagaaaagccatatgcctgaaggaatgcctggcggtcctcttcagatacatcttcaacccattccggcatatcatcgaaggtagccagcagttgccgttctgcatcctgcagccaccccagatgtcgaaactcttcgaacgcacgcctcaattcttctgaatctaattcgaaagagtattccactgaatcaatttttcgcgtgattttcattattattcaacaacctttctaaatataaagtgacaacgcggattaaatccgcgttgtcttacccattttgaccttgcttgcaaagcggcagttcgcacgatagcaagcacgcagtgtttctacgtcatcgtcgtcggtcgtcatcttgtaaacgacacgacgcataaacgcatcctcactgaaatcatctctggccagatccgtcatccatccaagcaggctacgcataccgtagctgccacgaatacacttggacttagcctcttcttcgatagccttcatcgtcttagccgcagccagtgccacggttttactcttcagaccagtacgagccatggcacgagcagccatttcctctgcggacggagtatccatcttgatacccataacacagcggtcacgaagagactcgttgagctctacgttaccggcataaccacggttagtcgtaatgacaacaatagtatccggatgacggtagatgcgcgagccattcggcagctcgatcgagccattcggctccagaagactgttcagctcagtaagtacgccaggacgcaggacagaagctgcctcctatagtgataggtaaccctttgatattatctccaagttttcccccacttcacaccgagcgtgcgagtttccccgcactcggcgttccatcgaaatttattctcttgagcgttagtagagttacttgtaaatctttcttgggtatagtcgatttagtccatagtagatgtagtttgagccatttccctcaattccttaactcgggtaatctgcttgttagagaggtttagcgccttgcacatagattggaagaggttcgtgttgacggtgtggattattttatggatagcctcatgtaccagcatgagatttccatagttatccttaccacccaaggcctttggagttttgtgatggcaatgaatctcatccgtcgtcagaaagggccatcctgtgacagcacatcgtccttgctgggcggagaagagagagattcgattatcgatgtattccaacgaccttccgtacgcaggttgccgcataagtgcatgcattaggtgtacatccacagtctgcagttccttatgcatcaactttcttcctctttctgtgtatggcgtgagacctctttttagccctaaagctgttttgtgttggcagtaactgatgggagctattggatatctcccaataaagcgtagctgtttagactcgctgtaatgcctccacatttgggactctgggtgccaatcagcagttttgttgagtttgaaagcacttttccagcttttatttaccacataggcaatgtctccaaagtctttcgcacagtcaccagccaatcggtagtagttgtgcataccattaaccatcaagttatacaggttgatttcatcctggataactcgaccatctttaggatgtttgactttgttaatttgctgtttgaggctttttattattctggcttttgccttcgaggatatatgggaagtgacaacatgtttccctttatgcattttaagtttgaattcgaatcccaggaaagacgcggagtgttttttggtatttacaatccttgttttttcgggggatacatccaggcggagacgttccttgagccacatggtaatggccattttcgctcttacagcctggcttctggttctgcatgcgacacggatgtcgtctgcataccgtactatatagatttccttgaggctggtgccactccttgccgctctgtactgatgactccgaatggggtatccatctttgtcatacatctccttgacgctctcgaattgagggaaggactgccattggctatccacccagtggtcgagctcgttaaggacgatgtttgccagaagcggcgagagaatgccaccttgtggtgttcctttcatcggggtaatcattgagccatttgacattttaatgggggccttgaggatttgcttgattatataaatcaatctcttgtccctgataccaagagcccagatttgccgaatgagcttagagtggtccacattatcaaagaaacctttaatatcgaattcaattacctgatgtaggttggacaactgcatcatcttatttagtgcggcaatggcattttctgcgcctctgcctggacgaaacccatagctgttgttgctaaactgtgcttcgcatattggttccatcacttgaaggatgcattgttgtatcaacctatcccatacacaaggaattccaagtggtctggtgacatctggttgccctgctttggggatttctactcgtctaaccggttttggtcgatatccgtgtttcccgcccaggatattccgtaccttttctacaacttcgttttctgtcatttgaccaatgtctttgaagaccaggccatccactccgggagttttgctccctttgttggctttaacatttctatatgcaagcagtatgttttccctcgactctatcagagtcatcaggtccgagaaactttctcgtttcatggcttttgcatatagggtatcgaagcattcctgaaggtcgtaatattccgcgtgccggattgcggcatcgattcttaccttttgattttcagattcaacaagcacaaggcatcacctcctctacatttcaaggaagggattccttttggtcttactcgtaatccttgttaaaaaactctatacactaagatatatactccgacttgaggccatccctccattcccattacaggaacttcttcggttcgacctctgctttttagcaccagttcatctgcttatatgtttcgacagactatctctaaatgaagagacctgatgcctttccttgttccgattctcctatcatgataaatacccttaggacgccactatgaccctgtcagtagaattataagttcctatgtgcctgtaacacataatggtctttcataaaatccaatcttacttaaccacactgaccatccctggggggatgccatgcatttctacatgttcgtcgtttagagccgtacactcgcagcttcgtcggacgggattcccttccccgtcattctatccataggtatctaagacccccggcatatcacatacagactccacctctggagccctttcgtataggcttattgcctatttacggtgtgcttctgccgacttcaacgggcttcgcacaatcaaacattgctgttcttttgcacgccgtagtatcagggagagcgtttccgggcgttaccccatcattccactcttcggaaaatcagttcgaagcaggatgcttttggttacccaagttctcctacttcgcctaaccttttcagttaggaacaagtcacacgaatttcgaccagccagccattctgaaatgctttcagcaattcggaaatgatgaactggtaggatacagatcccttctctgcctcatcagacagaatgcccatcagtcggaacattttatcttgaaacgccgcatgcagagcaagtgtaacttcctctacacccggtgcaggagtagtattgcccagatcgtgccatacaccatcaggatcgaatgcgatctcctcctcggatggaataccgtattcgtcccgaataagagatcttacaccctcgtttgcaagagcctttctcatggacaaaatcaggtcccgactcttcggagccgaacccctgaattcgtctttctccatgatctcctttacctttttcagaacctttctatcagtttccgaaatgtcccagtcatccatatcacggaagaccggatagaaggcgccaatcaggttggcgctttcaaaggtaggcgacattgtcatcttcgtacgcggaatgccgaagacatatgcccagaagattgagccggtggttttgccgctgccagcatcaccttcgaggataaagttcggtgcaagaccaacgcttttaccccaatcctgatggatgctgcgagcagcgttcaccaggacctcaggtgggacgtaattcttgtccatctgcggcacgagtttcttttcttcttcggacagcttatggattggaagaagaagttcctcatgaagttcctgcatcatttttacataatcctcagggctcttcgaatcctcatccagatcgtactcttctcgagctgccgattctccccaaatgatagaaggcgctgctttctccgcgccgaccagtacaaagggtgtagcctctttggcaaagcccattacatcgtctacactcaatcgagcgagcagaccatcagaaccaacacccttaatattgttgtctttgatgtctctgtaaatgatgccatcccattcagcgaaaatggacagttcatcagcagaggtgaccgcttccacgtcaatcttgaacatgtcgttcaaatgcttgatcgcacccgaaaggtctttaccttctgcgcccattcgctgcatgagaaaacccagcaggatcgtggcgcagaaaggagcaccgcttccggcctccaaagacgcatactgaatcggagtagtcgaaacgatttctgttccatccacatcgatagtgcatgcgctcagcgacatctcttgccagtcaaactggatgacacggcgcttctcggatgttttagaataaatctccgcatacaccgtatgagttgcttcgttcactgcgaacgttcctcgctcaaggaaaatttcctttaagcgtgccacgcttgcgccgacttgctgatgcacgccgctgccagtagaaagagccaggactctgctgtccgaaaagattgcaggggacaggccagcccattccataggatacactgctttcttagtcgtgtatcccataacccaagtcgtgaatctgctataataaccagccataatttttatttctccttttctgtccatgctgccttaaaaaaatcgtcagcatagcatatattaaactgttttttttctgctgtggttttacctgccacagccttaagaatctgaaactcggatgagttaaagattcggatagctaaaccatccctaaaataaagggccacattgttcataacaacaacatcgcccttttccggttggcatagtttccaccatgccactggttcatcgcctacgatcagacattttattgtctgatctattaactcgcccatacctatgtcgtttttcaaagtaactgaaaacgcgatatagggcacagatttttcggatatgcctactcgcccttcattaaagacactatcagcaatgttaccgattagatttgcctttagatgttggacgaccggcagtcctcctacatgtgccaaaaaagaaacctcctttcacattataaataaatatataaaaacaccgtctccatgtgagtacatgaaaacggtgttattggtaataggaacagcgctatatagaatagcgattagagacaaatactgcacgtcggcagatataaagagacactttacaataatagtatactggtgatttgtttgaaagtcaacgatgattttctcgcacaaacgaaaaagggctacagacaaattctgtagcccttccgaaaaaacgtttactttgacgctgcctctttctttgcagcttctaattgttcatccgaaaagttaggaaggttttcttggatgacttccttgataatctccggatctacaccctttttgaaaagagaaacagcaatttggtatgctttgtgctcctctattctattgaccagatttaacatgtggcatttctcctgtagtgatgtaatgtagctttgtatagaattccgcattatcctaagatatttatataatgcttttctccaagaatccattctttcagaaaatccccaatttagaaacaacgggaatatgctcagatatggatttttgagtaatctctgaacgccatgcatcatcagtctcatgaaccaaccgctgaagaattcccaaagatttttttgcggcaagcaaggaataaccaagtaaactttataaaatgctgcaaaggcaatgattacaaaggtaattgaagctatatatttttgataaacagccctttttttatttcttaccacgaataaattcacaataaaaaatgccaggattgtacttgctgctgttatagctgcctcatcattgtctgcacgtatgaacttgaagaaacacctgagacccagcgccaagccacatatagcaaacagaatgggcatcattaacaagaaaaagagagaccacgtcatctttatttgaggcgtattcttatatctctcatatatcggcttcgatgtgccaacagcaataagtgcatacaaaataatagataacattcagataacctcctattttataacagcaagcagaaataaaagcctccaaagcagttcaagcaatctaaatgcaggaaggccatgttaattcccgagagcggtacgcacgctgctaaaatgcatgtaataaggatttcgaggaaaactttctgcggtaaaccacgcataaaataagaagcgaagttcttggcgacccaaaatccaaaaacaaaaagcagtcccatatccaactctacaccaaacagagaagcgatgtagctaacaggaagagtagaaacgacatagccgataagcagataaaaaattgccgaaaaacccatggctgcgaaatcagaaacatcgcagttagaaatcgtcggaagttccttaatcttacggatgaagtccgtgatcttctttttaaccgggaaaatttgaggtactaaggataacataagaaaaactcctctctaaaaacaaaaaaactcctatcttcaatagatagaagttacgtaaaatgaatagctaacaactcccacggaagggatcaggaaacaaatacagaatttctgcaaaaaagagacaacttatattatataaatatcagatattcactatattgtcaagtcttttaataaaaaagcaaggtgcaacctgacggctgcaccttgcttcaattaaatttgatccttatacttttcgatcatttcagccgcaaattctgcatcgtccataaccttttcaatgtcttcttcacgaccttcattcttcagaaggcgaagtaatgacctcaattgattttggccttctgcacgaccttctgcaaggccttctgcaaggccttctgcacggcctttttctcttgctttgtaagcaacaccttcgctgaaattacacatttcagaaacctcctcacgcaagtcatctgtaatagaaatacccattttctccaatttgattaacttttcttcactcgacgcatcagtgtcaatcaaagtgttaagaacatctattgttttaagtcttggagggcaatcgtctgatcccagatacacgaatactatgcgctgaagatcataccgatcattaaatatttctactggtcccttgtgtacatcttcggtccatttcaacgatactatactgtttcgctcccccggatccggggactctacaagccatatgctgtaaattttgcgaatcttatcatagtccgatttaaagaaaagctcacctttttgagagctgattagtctgcttgcgtagtatacagctcttttaaccagatcataccccaaccgcttggcgttggagatgttctgagcctccaaattgataattaaaacgcttttttcttgtgttttggggttttgcacaagcaatttaacatcatatgtcactacaccctcgcttacagtcttatcttctgtactaaggccaatagcctgtcgcacggctgtatgagttgtatccgtatcaacaccaatacatgctgaatcgactgaaagaaagcatttaccgatatcatctagcgacatatccgaaaactctggcacagtctccttgacgatctgtgatggtaaacaaccaacttggatattaacggattagtgaatatccaagttggttgttccttatttttctttcttcgggaaaataaacttcagtttgtagtcttctcccaacgaaagagctgcaacgaattctttgcctttagaattagttaaatggaaaggctttgttgtcttcatcgagagaagctgcgcttcttcgtggtccgtcagtttatggccgcagacatttgtgttaagcgtaaacgcgcaagatgcgttcttacatttaagaccccatgcatattcgttcagttcaccatagcatttcgggcacggaaatggcgatacaaaggaacgtgccagtttcccatcagcgtaaacaattcgtgcagcatattctttccctcgtgctgacacaaaaccgtcgatcaagcgggtgcgtttataagtcaagagatatgcgatatctatcttctccatcggatgattaaatactatagcaggaatggtgaaatcacagctcatgcagtgccaatcaccctctggccccaggtcgccataactctgacatttaggacaaacacattcctgtaagcaaatacctccgcactctttcagttcttccgctgcttgctgcacttccacgcaaaggtcacggacaaaagcatctgtatccgactcgaaagagtctacatcagctgtaccctgcgcaaccaaagacagccggttaacccagttgaccaatccggaagtatcgcacaactgcgaggccaataagtatcttaacccctttgtgctgcgcttcgtgagtttcaagacattatcatcagggtctactgttaactgtccccacgcgatgagattatcaatagcattcgcaaagataagtggatcaggcaaaaaagcattcgaggccaactcgtacaaatccgttagcaagtcatatttcgaacaacctcctgccgactcctgtacagtagcggagaccatctgcaacggactcatctcggtcatatcggcattaactggctcatctgatgcagcaaccaacttggatgtttgcgccataatcgagaaacaatgaccatccgctgtcaactcatacatattatgtactctcagacgcttttccatgatcgctgcaatattgctctcacaaatcagatcgtagatcttcttttcgtcaactgtcatatctggaccgatggttttgctcgtgaccagaatgcccatgtgattatacggattattataggcatcccagtcgctgaatttatcgagttctcgcggcttgaactgatttgcaaagcttgggttgttgttaattgcaacactcgccgctgtaaattccactttcatacaccacggcatagcagagctctcggttggccatgtaatataagacttgttatataactcatacgccagatttactacgtactctggtttcaggccatatcgcttttcggcttctacctgcaaggagaaaatattgtacagtggaatcttctcaaaggtctctgtatgatttgttcgctctatatgatgctcagacaaagactgcaaaacctgcatggcctgctgcgcgggaaatgtcgaggaatgattatattgaacgaccgtgccatactctccattggacagttcaatttttatcttcggcgcttcgtctgccttcgactcatagcgcaggcacgacaaaatcataccttctatatatcccgaaggaaacatagcatggctaatggtatgctgatacatagcatttgttatattacagccaatcaaccatgagaaccgttcccacgatacgctggcagacagatacgcattacatgttgcaccgtcttccggcgaattaaacgactcgaatacacacgactctaccatcgagcgaggccgtacgcgtgaaatatgaatactactgtcagtaacgaagatatcacagaactgagcaaatgccagttcgccgcgaagattatcttctgctgcattgataataccagcagcatcgttcacgatctgctgatacaaagcctgtctcgcttcaaagttcggttcgacaattttgcgctgcaactcctgaggaataaacggcagcggtcgtttatcaaggttcgtatactcttcatcataatcaaccatcttatacggttcagagattgcaccatccgaatagacaaagagatactgctgcccgcaaaagaatgccgtaatatagccgtctgcaatgagttcagactctaatttatcgtgatattccgcatagttttgcggcctcaccttaatattgttggttaggactacgccatccagacgagtagctaaaagcattgctctttctctgctgttagtgtagacaacaatcacggtagatataccctcctcctgaaaataaaataaagggatccgccaatacaaaaggcgaatccctctaaatacggaattacataataatagactgaagctggatgaggatcaccgcaaaaatgatgatgccggcaaatccaacaatcatggggatccactgaattctgcgctcaccgtcgaactcttctaactcatccatagtgtcacggtccgtataatagccgtctgtgttagcacgagactggaactgtttacgacgcttttcctctcgcatcgcagcgctttctttgtcctttttcttcttattcttttccctcttctttttcttacgaggtgcaggctcttcttcagtttccgtagttgcctcctcggcggcaggctggatttcctcatcatcctgaggcttattctttgataagtatgcgagcgggttcaaacgctcattcgcccggggctgaggctgctgttcctgcatgggggatgactgctgttcctgctggaactgcgactgctgaggggacatctgctgctcatagaaatagccttgcggattcggcgcctgtcccacaggcggctgttgctgccagggcccttgtcccatagcattaggctgaccggcaaactgctgtgcgttcggcataccctgatttgggtttgacggtataggctgctgaaccggcgtctgctggggcggaaatcctggctgtgcatattgctgctgcgatcctgccggcggggtagaaggctgctgtgtatactgcggcggcacctgctctctctcaggcggaacttgctgcggcggcatataagtctgctgaggaggcgtctgctgcggtcgctgcataggctcaggctgagccgttggctgctgattaaactgcggctgttgcggtaccgttggctgaggcggaacaaattgcgactgattttgagcaggggagggtggagtaggagtatttctcacgggtgactgctgattaaaaaactgatccggatctacgaattcagtagtaccatctgctgccggtttcgagttctcttccttcttgcccatgcgaccaaaaatgcgcttatgcgatctcggagacacgggtttcggtgctgtcggttgttcctgcggggcaggggaagacggcgtaactgtctccggagtaggatggggaacagggggctgttgctgagtatgcgcctcacgcgttggttgcgaggcaggagactgcggctgtgcatgaacagtcgatgcagattgcggagtaggcggctgctgttgagcaggagctgccggcgtaggctgatggggcgttacaggagcagcttgaggcgccgacgactgttgccgaggagctgccgtatgcacaggttgcggaactgttttggccacaaaagaatggccacaattagagcagaatttaattcccggctgtaccggtagtccacatgacggacatacattctgctgcgggaacttatagccgcattcattgcagaatttagcattatcttgattttccgtgccgcattgagggcattttgtagacataattttcacatcctatcaatatattcgaaaagatgactatagtagttttctgttatccgtagtgagccatcacatagtttgcaaattcaaagaaacatgcgattgcaatgacctgcacaataaccaacaccatttttatcaagaagcgctgccagagaggacgcttattccgccttttctgcagagcatgctcaattacatcggtttcagtctcgttttcggatgaggtctgagttttctcagtcgactcattttcatccactgccggttccggttcgttctttggattgttctgcatacgatctcggtttttctggtatctatccagcataagtaacctctatttcaaatgttttctggtatattcttctcgctgattacgaatgaagggcaatctccttgaaagttctatttgaatatagctatccagatatgcttttccaatcaagcataattccttcagctcatcgtccggcatattaacgaagcatgagaacgttggtttttctccagttttcggggagaaaccaccgttctttgtattgacgcctgcaccctctgttccaacgaacgcaaatgctgcctgtcccagcccatctactaaagataacgagcgactaacgatcatattgtttttgaagccgccgccatactgctcaaaataatggttttgagtagagcctctctttagagcctctttcttctgacgggaataaacaccactaagtacattatgagtcagaaggagaaatcgtgcagccgggataaagaaagagcatatgtctgctctctgtccagtttcctttgaaatgtccaagttggacatttggaacttcatgcacggatttggttctccatgttcagtgaccatatccaatgcgtcgatacagagcagcagggaacgcttctcattcatctttttatagatagttctcagattataatctgcaaactgttcttttaccttcgccaaaaccgattcaccaccttgttaacaaacccagtcacgggagcctcgtgagtttcttccaaggggatatacttcagcagctgatccttgtgatgagttaccaggtcatcataaaaagccgggtccttcacacggatctgctcaatatactgacgaacgaacaacgacagatgacgtcgacagctatgataatcccacagcggaaaatcagtgtccttggacggactgcctaccattcgacgggtgtattcatccatcgagggaatatggatttgagacagaattgtttttctatattcggttgccagcttttcggcatctacatgtcgagagattgttccacgtttaatgatgaccggaatagcgaacactggaataaccatttcattaacaacgaaatgctgttcgtcatattcgctgcggttatatgtaatgccttcaaaaagagcatcccagccctgctgcaagaaaaacagccactggcgattatccactacatgctgcaatgcctggatctgattagagacgtaaacattaccctctccatactcagactcgataatcttcttcagagattcttgaatatcctgcggtacgctgaaatgacaagaaacattcttcgtgattacgcagtatttctgcacatgatgcaggatcgggagcatatacagatttgcatgctgtccaaactcgttagaattccaataagcatccattgctgcctgagcttcgttggtttgagaagcctgcacaaattgttcaaatgccgtctttgcatcctggctatggttattttcatccagccactgctggaaagacagttttccaggaacaccgaaggtgggaataaactcgatgtttgccttgggcggaactctaagccccggattgttacgcatcaggttagtgatataatcgtagaccgtgtttttggacataaacgttccaacgccggcaaagatctgtgcgcgttcaggaatactgtgttcaaaaatgcagcgatcaacgtcaatcttgttaatattttcagatttcatacatattcaccattcacggtactactggtattatatcattatcataaaaatcttgcaatatatatgtagaaccgatttatccttcttagattatatattctcggaaatacccgtatttttaagaatgtttcgaaagtaatatttgctttttacttttgatatagcaagaagttctccttctgatttctcagtagtgaacatatttatttttgcagttcgctggatatcgcggacagtaattccttgtatgctgttcgtacccgagcgggttgcttttcgaagcatttttccgatagagtcactcttcatcttcttctttgctttgctcacgaagagagtgttttttccgtcaaccggaggaatacggcatcccagatattcgtccaatgcttcctttgtttctgggtcgagcgggacgtgacgaatatctccttttgcatctgtaacccgaatgttattcagctcgacatcttccagtttcagatcacagatttcctggaggcctatcccacagcggaggaacattttcacgatacagatattacgagcagcgaattctctgctgttcaagctatcacagatctgcttctccagagcaggagtcacggtcttttgttccttaatctcttttgccggacgctgtgtatccattataaaagcaatgggatcagatgaggttttgaccgctaaccagttataaaacccatgaacaacgcttatccgaagtgcaaagctgccgggtttctctttcagtgtataacaataatatgagagataacgcttccattcggtttcagagatcgaagccatgtcctcgatagaaactctgtgaaggacaacctcatccggggcgcaatctaaatgtgctctttcatgcttgaggtattttgccaatgagcgcagcgacatatagtagttgtacgcagtcgacggtgataattcgcgtttttcaaccagaaagtccatatattccgttaaaatacccggttcttttccatatttctcagatattctttcacccatcaacaacacctcccttaatacaactcgaaacaccaatcagggtatttgtgcttaagcagcttccattttagaacgaaatcctttgttgtaagataccgttctctcttttcatcatagcctttaacatcttctataactcgcttaccatcccggatataagaaaagtcagccttgtatgtaatggcctgtattttctctccgttatagacgaacgattcttggataatgatattatcctggcgtttcagttctgagatatcgcccgagcgctgtaagagcaaaagctctctataacgggaatactccttcaagctatcgtacttctccaaaatgcgacccatatccggatcaggcctcttgggggatacacccttttcctgtacatacaccttaacgttccaatacttcgaagctgaaggcagcttcggtacaggagaaactgcttccgcaggtgttttctttttcttatgggtgttcagatcgcgtactcgcagctgagggttcttcgccatcatggcattaaactcctcacatgtcattgtcatcagaaaacacctgccttactcttatgtcttttgcttgagccagttatccaaaaatccttccattatccccttgttgactcggcccactgtagacaacatacactttttatcccaaagggaaccgttctttgcgtagaagatcctgagggaagagtattttcttatgagtgctattgtgctcatcgccataagcgtcttgagaatatcacttggggcaacagtaggtttgcaaatcaccacaactaagatgtatttcttatcaatttgcaactcttttaccgaatatcgatattgggcgcatatatcatttataatgccggtgatgccgggtacaaaatctttgccccatatttcagaactgaaccgaggacaccacaccaaacgatactgcatgctgcattctggatatatttgaattccatcattgagtatcatcgttgcagtcctccagctgaaacttttctttgagccctcttcgaatcaggtcagagaccgtaatggttttattctcttctacagagtaaatgcgcgaaagattttccaattgttctttccatgcgacagggatactcaggttgatttgcgtatgcttaatcagacttttcttacgtgccattttaatttcccctattataaaatctatatcgtatatgccttatatcttaaatacgatatataccttatgcgtaatatatagcttaactattatctatattatatatcattattagatttaattcaacatgtataacgtgtttgttcacactttattttcaattattcgcgtatttattttaattaagtctttctttttgcaatattatatgatataatctatataaacaatacaggatatataaatgcttttatatgtgatattttctcgttatatccatattgtggttatattaaaaattaacttgaaaggatgatttcccttgaaaattacaaaaaccgattttgtagcccatgtcgcaaaggagatggacatgcccaaggccgtagccacgaaggctctggacgcagtaatggctgtaatcggcgagcagcttatggctggcaacgacgtcgcgcttccggagatcggtacattttctctctctgtgcgtccggaaaaggaaggccataatcctcgtaatggcgaaacgatgattattccgcaggctaccgtgcttaagtttaaggtttcaaagaatctcaagaagatgattgctgacgtcaagattaacgagtaagttaaaaacaattccataaataaaacaagaggcagtttcttaatagaagctgcctcttgtttataagtgaagaaggtgcaggacaacgggaatatcctgcaccttcttcggttgaataaaatggaaaaagttcgcgctattagcgcgatggtgggccttgcaggcatcgaacccgcgacctatcggttatgagccgacggctctgaccatctgagctaaaggcccatgtcgagtttttatctttatgttttatatctacttcttcgaaaatctgaggcccagtgtttttgcgcgagttttgcaagcatcttttgttcttttcactaaacgcgtctgcacacgtgcgccttctttcggataatgctcccgcataatctgatcttcttcttcagtccatgaggtaatagagggatcctgcaatttaagtttcatgctgactgcacgatgctggcaagcggatgctgttcggccggggaggcgaagatgtacagcctctctttccgtaggatagtattccttgaggatagcctcctcttcttctgtccagcgtgagagcttatgctcttcatacggttgcaagcgtatgtactgagcgcggttcttacaagcatttctcgtacgacccggcagacgatggcacactaaaccgccttctttcgggtaatactcctgcaagatattatcttcatcttctgtccaagggactctatggattctgcagcctttaggcataatttttccccctgtctaatgggattgtggttggagctagtggacggacttgaacccccgacctgctgattacaaatcagctgctctaccagctgagctacactagcatgtggatgaggggcttaaccttgccgcccctcggaggctgtacattgggataaggaaacgaaacatttctggctgcttagagcaggccatggtcgaagtgacagggctcgaaccggcggtatcttgttcccaaaacaagcactctaccagctgagctacacctcgattgatggcgggagcgaagagattcgaactcttgcgacgattaccgtccttccggttttcaagaccggccccttcaaccggcttgggtacacccccatacagaaacgagacgaaagtctccatggtgcgccaagcgggattcgaacccacgcgccctcgcttaaaaggcgagtgttctaccaactgagcaatttactcttgcgctgatgtcgtaccgacaatggtacaaatcagacgattgaaatcgaaatctttcggaacatatcgaaggtattttgcgaagattttcgtaaattcttcgattatttcctgcggattcgtatatgccgaagaaaacagtcgaggctgcttcagtcggaaatacaggatatgttcagcatctattccagacatatcgtaggtctgcgagaacggattatgcgcagacacatcaggagcggtatgtacttccccttcgaaacatggaatgcgccgaatgttatccgaaccaagatttttgacgagaatctcatacagcggagaatcgtcgataaaatcatcaaagaactcaggaagttcttcagactctgccatcttgatgaatttatcattcgagaaatgacagattgcttttgtttcgggggataacgcatatgcgtcggggaacagttctattgccgacttgttgaggtatagaagcagaggttctaacacgataccaaaatcatatatcggtgcgtgtgtgctcatgggacattcctcctgtaatcgattcagagaagtttgttgtagcgcctgcaggactcgaacccgccctccgtttcctgacatgatgtttccccatggtccacatcaagttcaatcctacactccatggagtttcagactattggcgttcagcgtgcttccttacactcggctgctataacaaatggcgaggatggtgagacttgaactcacacgccgtcgatgacgggtactggcagattagcaatctactgccttaccaaattaggcttacatcctcaaatgtggcggggccggagagattcgaactctcgcaacgctattcacgtcctatcagttttcaagactgctcccttgaaccggacttgggtacggccccacatattgaattatggcacattgctgtgctaatggagcggataatgggaatcgaacccacgtattcagcttggaaggctgacattctaccattgaactacatccgcatgtacccggcaggcaagtgaatcgctcgtgccgggaagctgcaaagcagagataagggcaatccgcttagattatcacactgtctacttcccacccgagtgggtttcgcaagtacacgttcatgaccatgcacgccagcagttttcagcgttgtaacatttcttttatatctgcaataattgccctcttgcagacattggcgttagctacacgccatggtcgaagtgacaggactcgaacctgcggcatcttgctcccaaagcaagcgccctaccaactgggctacacctcgaaatggtggtccctgtggggtttgcacccacgaccgtccggttatgagccggatgctctgccctactgtggctaaaggaccatagggtggaagtgattgggatcgaaccaatgaccagctatcatacccgaaagccgctcttcccctgagctacacttccatagaaggatgtgtgacgtgctaatggagcggatgacgggaatcgaacccgcgtgttcagcttggaaggctgacattctaccattgaactacatccgcatatcccggctaaatctcgccggggattggtcatccactccaagataaggcgcttagagtgtgcacttttttaccacctgtcggtgaggtcttatgctcgaccggttgcatctttaacgtcttatgcacgacgggccttcgtattgaggatacgatatgccgaaattttaggggagcgagcgatgggggatgaacccatatttccgacatgccatcggtgtcttacattaagactacgcccgcatataccggcgagtccatactcaccggtgctataaatggggagaccacttagattgtcacactgcctatatgtacgcaaccacaaaagcagcagttttcagcggccgtggcagggatggctggattcgaaccagcgaatgtcggcgtcaaaggccgatgccttaccgcttggcgacacccccacaagaggagcccacgctgcgttgcaagccgctttccctcgaatcattgagaaggaaacaccgagaccattgtgatacgtggattgaggttcgcaggggctctgaacccactgcctacattgcatgcgaaccgtgttctggctcctttgcgattacgaaactattatatcactaactgatttattatgcaagcaatatattttttccacaacaatccatagagggatataaaataagcaaaattgagttcatattgtaaatgatctcaattttgcattttatcgatgatattttcattttatcatccatgccatgttggcgttatgtttttttgacaagatcttgcaagacaaaaaaggggctgtagatcaggcgcctttctcaatatatctaatgtttggcaaacgtttctctcttaactatcttctcttaagaactcctcggtcaatgaatggccgaggattcccgcttgttgttctaaaggagtaagtttctttggggtgattgctacacatctcagcagaaaggcctgggatcgcgatacgttcagtcgaaatcgtccagtgagagcgcgtgcacgctcgccgttcttgtcacaacaatcacgacgactcaagtattagcgctgtgttaggtcaatcctctaaggatgggtggatgccccttattcacattttccagatgagtcgatttagaaaagcgtttatcgactctccatttgacgcagcatatgcggcaataatttctttatctgtctgcttgcaagaatgttctagcttttcctgtagatgagtagttagacttttcccgtgaaggattacatggactaattctttggttgctctgcttttcttgacggtggctaccattactggcataaccggatactctctcatccgcacagcatccatctcgggaaataaactctcttggtggggaatagaagaggccggcttaaaccaaactcaaaacaacttaacccaaattacgagagccaagctatctgtcgccatcctgaggatgagttcttcgccatgcggtaatactactccattccaacggatgacaactgacgcagcgctttttcgtaacgcttcacgagtgagccattccctagcagtttcacacgatcaggttgtaagttgtgccggagatctgccagcttaacgcgtcgcgcaagctcgttggtagaaacgcgctcaatatatgtcgaatacggttcgccgctcctgcgggtcaaaatatcaacagcagcaacgacctcatccgaatatcctcggtcgcgcaagtcatcgagtgtaacggaagtgtcttcgacaacatcatgcagcaaggccacaaggatttccttctcagtagtcatttgctccgccaccgcaacagggtgaagcacataaggcacaccgagtttatcgtattggccatgatgcacttcttcgacaaagcgaaggcattcgacgattgtgtttgtgtatatcatagtctattctccaggaaacgcaaacgcgagtttggcggaaactcatcaggaaaccaaggagacaactgccgatgcagcactccgtcctggtcctcagatagctcgcttcaaactcacgagcacaatgcaaaagcaaagcgatccatctggacgccatcatccgaaaaagctcttaaaagtggccacacctactaagctacttgaaagttacttgtaaatacatgaaagcaaacttacaagtaaaccggaaaaacgccaccgaaaccaataaccacacctcgtcaatacttcccaaattatccctgaaataatgcgaaccaccctgccatcgtcccctaaccctccgttttcgttcgctttccgctccgggggagggcgggggacgttgctctggatactcatccgctgccggccggcggggcgtttgcctgcacggcacaccgttcactcatatttccgatgtccttcgattcccatcttctgtcttttggggacatattatttttttgtgtcacctttttttgcatgtgtgcatgtgatttttctgtattcattttcatttcttttttatttctttttatttaccagacttttgcctggagaagaagaaataatctgtggcaccggctaatttctacaaacgtagggtgagggttgggcgccgtggtggttcgcattatttcagggataatttggtatatgatacccatgtaagataataatacccatatgaaatgatgctgttttcccaatatcgacagaagatgggaagggtggatgaggaccttgtgcgtggtatctgacgcatggcaggtctatggtcgctatatagggattatcaaggtgcagttctgccgctatacgacatcttgctctttgagagcagcatatcgcgcttctatggctttggtgtagtggtaaccggagccgctgtgcgtgtctgctgctgagagcaagctgcgatggtaatacgctgtttttttgcgaatagacggcatggaagatagtttctgaataagtgaaaacagcactgctttgctgcattgagcataggctgagagtacctgcgtgcgtggcactgttgtatcaccgtatcggattcgtgtctgttgagagcaatagtctttagccatgatattaaccaggtgcgccgctatatctatctgctgctttttctggttttcattagtggccatgagcgttatatctctgcatagagcgtcataagacacttgctgctggaccatgtttacagcttgttggtaactgttgctccgatctgcaaatggctgattcgaaagcggtgttgtgagtttgttgcgagcttcgttgaaacgatgctgtataaacggagagttggaaagagcatgattaacatgctgatataccgacgaatttttcgtgggggtactctcgtttttgcttggggtttcagctgttttttgcgtgtcgggtgcttcaacgctgccgttgctactgtctttttctgcgtgggctggggttgcgattcgccgctcggcagtatctgcttcgggcggcgtaatggtggcacctgtgatcggtgcgatgacttttgatagtgtgtctacgagagtagagatgtctgcttccgatgtagcggaggacagaatgatcggcagaataaagacattggtgcctggcacctgatgcaacttagtgctgagagatgcctggggagtagtatgttcaggcgcagctggtgcgctggacggcgaaggtatatcctcatcagcgggagcatcgttggaaacggtttcttcttgcgacatgtagtcgtaaagataaatatggggatatgaatcatactgcgtgcgcacaatacggatccatttagaatcctgcatttgcttgagcaaagacgtgatcgtacgcttgctgcacgaaagaaacttcgccatatcgccgttaggtatagtacaataaggctggtccgctttgtcgatgcaactgcctctgccataccgcacgttgcggtggatctcatcgaggaggattgcatacaggcagacagccttgctgctgatattgccgtcagctaataaagagctgggcagcacatagtagtgccatgacgccatgtagtgaagagttgctggcatgacaaaagggaaggaggcagagccgttatcgacgctactatcggtccagatacggacatagatcttatgcgcacgcttcatgtgattggctgcacatctctgtcgctcaactgcgatcagaccagcagacgacagggcggcaaacgccttgcgtatctttcctgctgaccagccggtgatcttctgtatagaatcttgagtgaagtatatgtaaacgcgacctgtgctatcaatctgatggccggcataggatgccgagcgtgctcggtcaaggagcattgcatatagcaggatcgcgtcacagtttaaccgcagcgcatggccagcattacccagcataccctttggtatacgcaagtatgaaaaaccggttgtccgcacttctttcagaattcgcttgtccataaactgacttctcctcctttcttgtgtattttcctaaatgcctcataaacgcaatagaatttttgattcacgtctgtaatttacaacttttttttaaagccgtcaagagcccgaaaatccggcaactttgacgaattcagaaagtgcgcgtttttgtacagaaatccacatttctttttgttatattggcgaatatatgaatataattgttctcgttttgcgcgtgtctgtatttagtatctacacaaatgatgtagggtatctacacaaatgatgtagggtatctacacagataatgtagggtatctacacaaataatgtaggggtaaaattcaaaaaaaattttttatgggcggaatcagtataaagtcggcggttactatcaaattcacactaaaaaccgcaatatcgcaagatatgtaaatggtcagatttggtgagtacaacatattgcggtcaacattgatattatattgctataagcgtaacattgtgaatattttaacatttataggatgtataaacttatggaacgaaaaaacaaccaatattcactgcattatacggattttgatacttatatgaggggtaaaaacgatgaatgacaagcaccaatttgggctgtttgatagatatataaaaccaaaaataccatgaatgaccaagttgaacattttatctttttttcacattcacccagtttccggatatatcgccgatatccaactttgatattggccgcttctctgcgcagctcatatggcgcgaaggggtacatcatttgtgtagatacctccttttatccgcaacataattctgaacaatatcaacctacggaatgattcaatgcggtaaaattggacatttcacgcataaaatataccttttaaaagatggttctccgagcacaccctacacaaataatgtagggtatctacacagatcgtgcacccttgggacgagcgtaattcaccggaaatgaccaaattggttgtttcgcaataatcattgtcgcagaggggtacattatttgtgtagatacattctcttgtccaaaacagaaatctgaacaatttcaacctttgaaatgcatcaatacggggaaaataatatatttcgcgaatagaatacacctttcaaaagaggttactcagagcgcactctacacaaataatgtagggtatctacacagatcgtgtaccccttgggacgagcgtaattcaccggaaatgaccaaattggttgtttcacaacaatcattgtcgcggggggtacattatttgtgtagatacctccttttacccgaaacctatttcggaacaatatcaaccttcaaaataattcaatgtggcaaaatggtgcatttctcgaatataatatgctttaaaaaagaggcttggcagcacacaccctacacaaataatgtagggtatctacacagattgcgcaccccatgggacgggcgcaatacaatgggaatgactgacttggttgtttcgcaacgactccttttgcaggggggtacattatttgtgtagatgcctccttttacccgaaacttatttctgaacaatatcaacctatggaatgcctcaatgtggagaaagtgtatgttctatgaataaaatacgcatttaaagagaaggctcacagcacacaccctacacaaatgatgtagggtatctacacagattgtgcacccttgaacgagcgcaattcaatggaaatgaccaatttggtggttgcgcaaagatttctcttgcgatggaggggtacattatttgtgtagatgcctccttttacccgaaacttatttctgaacattatcaacctctgaaatgcatcatcgtggtgaaagtgtatgttcaatgaataaaatatgcatttaaagagaaggctcatagcacacaccctacacaaatgatgtagggtatctacacagattgtgcaccctggaacgagcgcaattcacggaaatgaccaatttggtggttgcgcaaagatttctcttgtgatggaggggtacattatttgtgtagatacctacttttatctgaaacataattctgaacattatcaacctctgaaatgctcaatgtggcgaaaatgtatgttatgagaataaaatatgcatttcaagagaagactcacagcacacaccctacacaaataatgtagggtatctacacagattgtgcccctggaacgagcgcaattcacggaaatgaccaatttggtggttgcgcaaagatttctcttgcaagggaggggtacattatttgtgtagatgcctccttttacccgaaacttatttctgaacattatcaacctctgaaatgcatcaatgtggcgaaagtgcatgctgtgcgaataaaatatgcctttaaggagagggctctcaacacacaccctacacaaataatgtagggtatctacacagataatacacccccttattttatgcgcatatcacggttttaaactgatgtaataatatctgtgcaagcaggaaaacagccaacataaaaagaaacaataattggagatacatgctctattttgattgattatatgggttatagaggatataatgagtatttactgtctgtgttacagaaaggctctacgccaaagaataagagtatctacacaaatgatgtacccctgtttttgcaatttatcattaagagatatttgtagctgcgcttgtgagctggagtgtaaatacaggtctagatttggtggtattattttgccgagtcttgtattggaagggaagttgctgaacgcactttttttgtctgcgtgttattgaattttggcgattttctcgccaactcttgattagagttctaggtagtaaactacctatgcataaaatcgcgattttcagcggcatacttgaaaatgaatggcctgagtaactatagagtggttttcagtttgtaaatgttctttatcactgaatgaaaagaaagctgactctgaaaaaacaccgatagatctccggggagggagacacccacaactcggcaaaatatcaattttgccgagttgtggggcaagagagtgatatatattgcacaaccaatcaaataatgatataatcttagtaaattgtatattcgtgaaatatttgaaattctaatagtaaaatgattaaaattatctttttctgtctaatttcaagaacaacaaatgcaatctattggtgaatagattaaaatattattttatccatagataaatcagcactaactattagtaaataagttaaaataaaattatttttaggaaatagattaaaattttattctcttgattgcatctcataataaacccaaaatattaaagttgcgattatagcaacttttccttgctttttctgtgatattataatcattttctcattttctgtaaacataatatgaataaaaggagtcaagacgatggacgagataagacaaggcgagctgatggcgcaatattccaggcaggtccgaaagaaagcaaagacaaaaccattctctcaggcaacacttatgatgcgagcaaatggtacagctattgctgtccttgagttcattgatggaatgtcgttccgtgatttatcctcgaacctctatttcattgcgcaggatcttaaatccgaagagtttactcgtaaatatgaagcacagatagagtatgcagctgtaaagccgcaggagttcgtgaatggcatctatgctttctttaattcgatcgcaaagcatgtgaaggcaaacgacctctaccctaccttctttgagtttctctcctttttatctcgctatcgagtggagatcaacgatgacaagagcatacaaggtcgtattgtaaacgcatatcaggcattgctcatggaaacgcttgagtttctgagacccaataagttcgatttgcgaaatgtagttgttggccaggcttttgacggcacattgctgatgaagccggactctcatcccctgtgcgatgttcccatccgtgatctggaggattacctaaagactcatccttttgatatagacactttcaattcccatgtatctcgttatttcaaagcccatggattgaatgatgtcgaatgtatggaggatatagatcgaattactcaagaggatcgagctcaaactcatcaaatatctatgcttgcgatgtttaccaacgagtttacctttgatattcttccggatccgaagaaaaatgttggacgcggattgcagggcttcccgacactgaaaacctcatccgtggatgttgaagagttgaaggctgttcttatgcgcaggtccagaacactgcctgcaaacggtatggtgtatgacctgcattacggtgacgagaatatccagaatgatgggcgttttattcaacatgtgctgcttcgtgaaaatttacacggagaccatatggttgttctgtataaggcatattcggacgtgttcgagaccagcggttactacgacactaaagatggcttcttctatactgttctcagagaagctacagataaaggcccctcctgcgagtttgaaaagctgatactcacgttgtatgcggcggccgttactcgcgatgggacttccctttcggcttcgcttccggaacattttgaagtttttttggagcgaggcaagcagcatattcctatttctgcagagcctttcttgcgcggaggtaaattaagaaggactgatggtcaagaatctgaagccgaccataaacgcgatttcgataacgacaactacgagacgaaagcaaaagcaatccaaggctttacacgtaaagtcggtatcggcaaaacaccatctgcggaggcagtcgctcgtgcgaaagcactcggatttgaacttgcttcggatgaaacatatgtgcagccgttcatcaagcaaattcattataagaaaaataattctaataaataaattaaaaagctggccttttggccagctttttgtgatgcaaatcatttgcaatacaggtttatacctcctccctgcccgttcagaatacggcaaacacggagttggaataaacactttggaaataatgttttgccgagttattgacattcctaccgagtcatggtagactaagcacatcttcaggaactgaaggaaatagagaaatcaggtgaaacatgagctttacaaaagatttgcccccaatagctgaggggttcctgcaattctgcctgatgaatgagaatcgctctgaaaatacgatttctgagtacgctttggacttgaaagtgttctttcgatttatgatgcagcagcgcgaccttgttccggcagatataagctttgaggaaattcccatttcggatattgatttggcgtttgtggagaatatcacacgccaggatattattgattatgtggaatatctgcgcatgcaccgcgtcagccacgcaggaacggcgaaagaatcgacgggactctccccttctgcaacacgaagaaaaatctcttgtatccgcagtttctttgaatatctctgcgtacacaaggaacttatctctaatgatcctacgacaggagttattcagcctacattaggcaaaacgctgccggtctacttaacggaaaatgaatgcttctcactgttgaaggccattaccggtccggataaagaacgaaattttgccattgtcctgttatcgttactggatgggctacgcgtttccgagatcgtagggattaacttaaatgatctcaaaatttcggatagtgaagcagtgttgactattcacggtaaaggtaataagcagcggcaagtgtttctcactcagaactgtgtagacgcgatccagatgtataagcagactcgagaagtaaaatacaaaccggataagaaaagtgagaacgctcttttcctgtcccgtaagcacaatcgtatgagtgtagatgcggtgcagctgatgctgaagaacgcctgtcaaaaagcaggcgttacattggttagtccacataagctccggcacacgtcggcaacacttatgctcaaaaacggtgtggatctacgtgttatttcagaaatcttaggtcatgcttccctgacgacaacacaacgttatacgcatgtcgaaagtgacgacatgaaagttgcggggtatgcaaatccaatgtccaaagcctctacattgagccaatccaaagatgaaaaatcatcaaaggaagacaatgcggctgtgaaaaatgttttagatgataacgagaaagagtttataaaaaaatattttaaaatttgccctacatatactgctgatgtgaaaagggatattggctttgagtatttgatcgagacattgaaggatcagcagagggaaacgtcaaatatccccttcatcgaggcagtctatgaatgcgttaaacattgggggcgagttgcaacaccagctatgctgtaccgcatcttaaatgggaaaacgaataaagatccggtaaccgaagaacagtgtctgagaactgctgcccaaatgaatacccttcgcttgagaattatagaactcacacagccaaccgatgcagatctgggcaagacatgtattataagtggagcgctattgcgagcggataatgtttcaatcacgatagacggtgaaaaacatagcgtttattataacataggagctctcggatctttgatggcacttaggagaggaaaaaaataaactatggcaaaacaggtttacgatgaaaatgatcagatggtaatggacactatgcaggaatatagtgaggatatggattctgttaccccacaggatgtaaagaatttgtgtgtgactggctttccagcggatgtttttgacgatgtacttttgcagaacaagaacaaggtgcctgtggcttcgcaaacgccagaggatttggaaaagtatatcgaggatcattcaaaagaggttcctaaactcaacatctctggtaccctgttagaagaagcgaaagtaactcaacgttttgacagcgcacatcgttcttgcctggaagcagtcttttcgcttatgaatgcaggtaatacttgcgcaacatcggcgatgatctttcgaaccatgaccggcggcccccgtggtatgcgtgttaccaaggcacaaaaaaaactggtggatgatttgatgtcttccatgttgtacagtccggtgagaattgagatgccgattgtaggaccggatggcgaagtggaaaaaacaataactttggaatcccctatgattgcggcagacaaaatgattatgaagatgtctggtgcgttatgtgttgcatatcgctttaagagtagttacttttacgactattgtcgcagaaccaatgctctaattaagacaccctacgatatgctctttgtcccgaagttgcaaaaaactgagcgaaatatctctttgatcagtttcgtacagcgcaagctggcaaactacttatatccaacagacaaggagtatgtgaagccctccccgctgacggttgatattgaggaagcgtatcatgctgtttatcccgggactgataaaatcagctacacagagaaaaatcgcataaggagcaatatagaggtcatccttgatacattaaaggaaaacggatatatcgtcaaatggcattttgtccagaatgctgcgagtgtaaaggctgtccgtatcctgtttcctgatacggttccgcctgtagatgattttggagaggcacttaacctattccagaaagagtgactttgtatattcttgctcataaaaaagaaggcctagctattcagctaggcctttccttttttcaatgattttagatattcgatttatgttctccctctgcccagatcatctgctttttttaatttgcaatggcctgaacccggatctcaaaatcgagatcatcttttgcagaacgaacaatataggtattgccgttggcatccataacgtcatatccttgcagggccaacgcggactcaatgatatcgagcacattcagctcttcttcactaggaagaatgcaagtgtcgaatcccttgtggcaatagccataggtatcggtcaggtaatccgatacggcatccatctttgcatcgcaatccgaatccggatcgatataatgctgtaaatcctcatcattgatgagaacctcggtaggcagagcctccagcagcttcttatcatcgtcagtatcccagcggatattatatgctttgatcattttcgttttccttctttcttgaaaaaatccttttggtacggggctaaatcactttcattagtctgtgattgtaatcgaaaattttgcactctcgaatacatcaccgatagaagccatcggacaccacgacgatgcttcaatataggtcgggactccattgctttcctcgacttcatctccaacgattccgtaaagataatcggcaatatcggcttcgttgatggattcaaaaatgcgagtcgcgccattcgtaagcacgacaatcgcttttccgtacatcgtaatacctccagatcatcgtttcattagattttatattctaaatctactttatttccatcaaatgcattccaccgtatatcaatatgctttaaatctaagaacttagcaattgttatagtagctggaatattatcgtttcggttattcacgattgatatactaactccataatacatatttctatactcatttaagtttatctctggctcgccaatttttttattcatatcattgatagattcaagagattttaaatcgtaatccctttttgtctcaatagagatatttgtttcttttataagctcattaaaatctgaaacactgattgtaaccaatcttgtatgttctttatcatattttttaaattcattgatcattttatcttcctccgttcttaccaataaatccttattttatcagtctatattgtcgttttcttttttatattctacaatcatgttatcatctccgaacatcgtttagctattcagacaccatacgacacaccgttcaaacgagatattgtcatacaaagtatccgaatcttcgccagtcctccagactgtatatccatcatcgtagttgcctgcaatggaatactcaccgatagtaaatactccatcatccaagcggatttccacaagactcactccttccaaacttttgtttgtcattttgatcttagcaccgctctgttcatcgttttattaagtttattgctacccagcgcttggcactaatcagcgatttgcatttagctagctctaaaaagcctccgcagttctccacttctacgataaagtgatcaccggtgttgctgatccaacaccatttgccgtattcaggatgatgaatttcagctgcccactgcataggtttttcttcatcgtcacattcatggatgaccatccaatctaacgcagacatatttttcacctactttaatacaattaactctgcttcttcgacatatttctttgcagcattatatccatttctattaagttcaccttcaattctataccaaagtgaatctaaaaagtttggtatagatacaaaatttttgtttggatatttttctctatatcgtttatacgccgttttatataattcatctactaaatcacgcttcattgtattttctccattcttccaaagaaactcttgtttgcttattcctcacgttcgaatatcgatcttggctgaaatcgtttgcaattctaacatctgtgcgagttggatacatcaggacttcttatattttgcaactgcatcttcccagtttgcgatgatacaaagtttcatccttacaaaatatattctcctgtttctaacgattgtgggattaactgtgcataatctggatgacttacaaattttacatatttcaatatgtattcctctacattgttaaattcctcttcgtccatttcattcgcatctttcaacccaagtttgaatttttgtgagacattatttactgcatcttcaatcggataatattttttactcatgtaaatttcctccgttcttctcaatgaaactcttgttttatgtttatataataatgtgatatacaaccaaccggtgtacgcatcagcttgattttgcattgggttcgcaaagttcggcaatgtgagccacaccgttatctgagtacagttccacaccaaactcatctcgcagagcatcgttaatctcatcgaccgtcatttcgtgacggtcaataaaatcgttgatgccatacgccttttcaaagagacgacgcagaaagtccacgctatagttggctttaaccagtggctgcgccatcagggagaaaccagcgtagagggacttttcgcgaaccttcttcttgaagcgtttcagatcacctgcgttgcgaatgttatccggattgggaatgtcaacacgtttcaggcctaccagattttcgagatgcgtgagatctgcattaaggcggttctcgttctcaggctgacaggcgatttctgaatagttattggcatcgttccataactgcagcaggctttctttggtcgtttcaggaaaatcaattaaagcccccataaaacaataccaacagtgcagcaccatggtggatgtggcttccgctaaaatcgcctgtgtgtcaactgccttcgccgacacaggcatcctgtgagggttcttcttgtcctttttgctcatatatctggggatgcatttacagcatcccctcacctccgtttcttttattggggtttggaactgattaaacgtgttccatcagttcatcgtagtcgatgagcgtcatcagacggccgtcccaatcgaaatccttaaggatagcgtcacgggcctcacacatgttccattccggctcatcaagaatgccgccatcgaaatctgtgtagtccgagttatagagggtgtaatcataagatgcaccctctgttcgctggatagcgatataacccttacgctcaattttccaggcagcgcaatcgtctgtgataatcgcttcgggtcgcactgttgctgcaattctcttgcacatctctccaaactgacagatgtgatatacatcgtcacagaacctgaaatgatacggatctatgtactggcagtggccagtcatcgtgtccttcagggtgtcaagagatacatttgcaccatctttcaacaggaacttgtctttgtatgtctcatcgacaatacgaataactggctctacagcttcttcttttgcgataagccataatttcccgaattggggtttttcgagcatattcatcggcacttcggcgatagcaaacccgataaggccgcattcattgattgcagccatgaccgcatttagcgagataggcagctgctggtactgttcttcgattaccggaacttcgaatacgccgctggcgatgatgcgattatcctcgattgagagcagcacatactcgatggtggctgagccgttggtctggatatagaccagaaaatcgtcatctaccataaataactttttcataagagatccttctttcttaatatatgggtgtgtagtgtaactaaagttgcacctccttttgattttgaatgaccaggttggacattcatagaattatatataaaaaagcacctaccggttgtacgataggtgctttgattattatagtgaaacaaacaactctattgagttgaaaggcagactactactttaaaagtagaaaagagacacattgcaatattatgatagcataaaagactgcattttgcaaggattacagaaaatctcttgtgatttcagtttcggtagttttgagaatagaattctctctgtacgcacacaacaagcgcgtaacgtcaaagaataaagaaaaagcgcagacatttctgcctgcgctaatgttttggggcgattctggtaagaaccttattttttactcgcctgtaaagcggcacgataacattctttagagcaaaacttgttcgtcatactatggcggataaatttcttgccacagtatgcacaggagatatatcgcccattttgaatggccgtttggatacgatgcttctgacggcattcgtcgctgcaacaccccttccctgtggtaacgcctttatcaatcagtcgcgcaccgcaaacgggacaagtggctcgtatcgagatagacttctgatggcatgcagcgctgcaataaaatgctttgccgtatgcggtaaattttcttccacatacattgcaagtacatttctcaatgcggcgattgggcgtgtcaccaacatggtatcggtttaacgcctcagcacgagcgaatgagtctgcggtaagattgcgttttctgcaatcttcacaaaacttctgcgagtctcgtacaggtgtatacagttcaccgcaagcgacacaacgttttttcttaagcgttttaaacaccccttatgcttgtttcttggtggatttccgctgtggaaaagtccaaccatacactcggccgatatcatccccgagacgccgggtaatacgagtaatatcggtacgggtagctacaccgcgatagatcttatctttgagattatccatctgggtttcgctgacaccatctttatacacgcgataaagatagtgattggatccatcatggtggtcagcgtcacaacgcagatcgcccaggcggtcaacataccatgtggaatagtccgtattggaagacaagcagtccttgatattcccgctcgcaatttcccgatatgcgctatgccggccattccacaggccgagatcggcaatgatcaggatgggcatatccagctggatattgagatttgttcgctcatcatccaactggactgcgttcagctcgtacatgcgctctatgcgttcgtcttctgaaagctcgggatattccgcttccaggtcagcacgccaatcctcgtagttcaaatcagtgttgctccaaatcaggtgtttatattcagacatattagttagcctcctcattagcagtattttcgatatctacctgtgcaaagcatgcatatccgtcgtaatcgtcatcgaagcgataatgcgggcagctcttgcagggttcttctcgggtacagatgtaagccattatgattgcctccttagcatgcgcttgaaagcggtttgcactttgatgatagccatccttagagcttcttcgtcatcataggcgaataccgaagaactttccgggacaacatcaccatcaagtgtacggccgtcaagcatgatcttcaaaccatcgggatctgctaaaaactcgatatgcagagtctcctgttccgagtaagcatagtctgcggaattttcggggagctgcgcaatcaagtcaatagctcgaatgatgtccttaagagatcttgcaaactcaaactggcggattaactcactgcgggagtgaatatccagcgcggatttcttatacccgccgcaccagctcggagcagaacgtttcatgagtttttgaaacatttcttcttccctgattgagtttgaaatctcatccgactcgccagttacaaaggtatctcgtacacttttctccagaattcgggttgtggcccgcttggaagaagggtgacgacataccacctgtaacgaatggtgttcttctacggattcacagtattggcatcccagacacaatcctgctagtttcattttggtggggcgtctattgacgccccttccctcctttggatgattatttttcggtaccgtacaattccagtttggtcatgtcatcggcagtagcaatgccggtgcatttgacgtctttgttggaatactgctctgcctcgaatgtgatatctttggaatcgagcagagtataagcggcgtcttccgcactcgtacgattttcggatacgaccattactgttttataatgggtttccgcaatctcaacgagatatggacgcttgcccttaggaatatcaaacttggccgctgctctccacccatcgtgcattttctggaacgcagcgacaagctcttctggtgtcaaagcgttcgcgcatttggatggggccaatgtagtggtcgtgaacgagttgaactcattccattcgccccattcaccgtcgtcgatgccgactgcatccggaataaaccatttgccttcctccatgcaggatacgatatgagtcttctgctcctctgtcaattcgccattgattgtatagcggaatctctcctccgcagtatcaaagacaagctgcgtgtactttgatttgaaccatgtgcacatatccagcgccttagcaatggagctgaaggggttcgataacgctgcattttcgttgaaatggttcatcacatggagcaaagccgcctctggggtgcgataacggcgagtcattgtcgaatcggtctgccgattgacgccggaaatctcatacatatacggtgcataagtgtcttcggctcttttaaaactcaagtaccagtcttcaaactgaaacttgtgttccttgtttacttcccaggtacgagcctctgtaatccacaggttaaccatgtctttcgtgagtttgataaagtctttcatttgtatcactccttaaatcaatcttctaattcaaccatacctgtcactttaatatgaagaagagaatcatcttcataaccgacaattttgtagtcgatgcccatcaagcatggattgccgatgaggttttccgagaggatatccaggaaaccctcgaaatcgttgtttataatgtcacggagttttactttaacgactccgctgatgagaccatcctccttcatggaagatctgatttccttgggggtgtacggatgttcgactatcgtgtagttgttcatataaaatcactcctgattgaaacgatcgtatggttggtactcagccaccataaacttcataacgcttgaagtcatctgcctgtgcgatgccgtcacagctggtttcccggtcgacaaaatcatctggctcaaattcgatctcatcgctgctacagcgctcatgagcctgttcttctgccccttctgccccttctgcccagataataacggtcttgcagtatacctctttgatcgttactgcgtagggtttgagtccttccttgggtggaacaaattcccgcttccatgcatcgacatgctcgcggactctacggatgaaatcttcgacagtcatagagttcgtcgcaggcagattggaggtgctgtagccgctccagtcgcaatcgaagtcgccactgaggccgaaagaagacgggataaaggttccttcctcatcgatgcaattcaggatttcagcttcctgctcgttagtcatagacccctcgagaatggcctcgtaggaagtcttcttcttattgaattcatccttgtgaaagtattcgattttggtattcatgtgcttgcactcctttgttagcgatttgtttctttgttgctttcttcaagcaatttgttgaggttttcgactgcatcagcaagtcgtgcaatctcttttacgagtttcggcatggttccgtataagaactgttgtccgcctcgagtttgatggaaatccatcggtgtgtcctcctttcctgaatgaccaagttggtcattcacatatttatatataaaaaaacacctaccgaaaaattcgataggtgttttgagcaaataattaaacagtcaatccaatggattgataagggacttcctcgcttagagggaatgagagacaattacaatataataatagcataatatctcaagcaatgcaattattatgttttctctctttacattcacttcttcattttaatcggcggcagttcctttttatcgagcaaagagatgaaaccatccaatgtctctttgtagatgcgcttgtagttctgcttatttgcatccaaggaaggatgaaaataagcctttgcttcattgccgcacattatcgtggacataaagttgtacgaggcagatatgagggcatatggatgtggccccatctgcttcaggctcggagacatttctttcgaaatgcagcgagcgtggaatccatctgcgccgattctttggtagaagttaataaactctgtgatcgagttgggaaaattagagcgtttgaccacttgcagcggctcttggttgcgcgtgaattcaacatctccgtcagaaaaagcagtacagtgcataaacgagtacactatcattgccatggtaggcggagtgcttacgagctcaggcgggattattagaaattcaggaaaaccaaagtctttcataatagtatcctccttcaagatatttcttatgtgaataatagtaacattgttattgtgctattgcaatattgatattcatggtaatgcggaaaataagaatattacagcgggtaggtatggcagataattgcggctaatagttccttcggagagccggcattataaaaccttgcccctgtccatgaacccttagttccgttaatgccattcataactttgatggcaacgccggccccactgctatcttcttcccactgatgcaggttcgacgagtaatcgtccaacagaacgaatgttttatctgttggatctacggttttgcagacggtatcccacttggaggcatcgcatgggcaaaacagacggtgtgcatttggaatttctggaatgtacttgtccagccagagattcttctctgcaatcggatcgccctttgtctgcatgtatgcactaagactatatacctgtaccccgtgtcggatgagatagcgcacattctcaaccatctgcgtatatggcggaaggttctgaaaataccctggctcaacgagttcttcgggagttgtggttggcagccactgtgctacggtgccgtcgatatcgacaaaaacgatggttttctccataattggaccttctttcttttgaatgtttaggggagatgctgtaataacatccccccatttttgttgacttatgcctggctgccatacagttccagcttttcaacatccttaggtgttgcaatgccagaacagatgcatgtacagtcgatggagttggaatcatcgagatgaatggttccattgctacaaaggtcatccgcttttgcgcaagcagtatctttgtccttggcccagaccaaaaccgagtggaataacgtctctgtaatttccatgacatagggacgctcatccttcggaatgtagccgctgatattttcacgccagccttctcgggccttacgaaacgccgcaatcagttcttccggcgtttttgcgtcagcagctggtgcttccgttgtgttctggaaagagcggagctcatgccatccatcgctgggttccaaaccgacatcgtcagggatgaaagcgccatcttctgttgcatccatgagctcactccactgctgtattgtaaactggccgttggcaatatagtgatactcttggatttcaccgtactcttcatcgtgccaaatataattgagctgggtgttacaccgtagtaatccgctgcgtaatacatcttcaatagaggtgaaacgacgagtttcctcgctgaagcgatttgccatatgaatgagcgcatcttctggggtggaatactgatatttgacagttacatccgggtatgcaatcttctttgtcaactcgtaggaattatcgcctgctttgcagaacgagagttcacattccctgaacaaaaaagaggtggagtgtccctgttcccaggaaggtgcttcagagatcagctgtttcgccagttcggtagttaatattttgctcatttgaatcaacctttcgtattttttagtgatggacgggcagatgttatcgtaattctacagagtttgcaacatggacaggcgtaattcgccaattccagttattgcgatccgcagtagcattgatatacgcatgtgccggccgcagcgagcagcctgcttcggtgagggtaaggtccttgccttccctatctgcttctgcaatcatcttgcggagtccggaaacgcctaaaagctctttttccgaagcggaggtgtaaattgcagcatcggccttatccattacacggagaaactggagcagcatcgtgttctccgcttcttcctcggtaaggaagaactgcggagcctgaatgtcacggtcaacggtgcagctcaggacatactcctgaatggagcaatcctctacttcccatcccatggggccgcccttctcttccttcatgtacgcttccaggcgaacgcccatatcggtaccatcaaggcagttgccgatgacggagtaaccggacgtattcggatggaacgccttgttatccgaactgataacataagtgcgatcggtcttagaatagggttcgcggaagctatcctcggtgaatgtgatgaaggccgtcaaatgcccgctcggcttgtttgcttcgtgcgcgataaagatttttttgagttcctgataagtcatgataaaaactccttttttatatagtgggtttgaaacgaggttgttagctgatagaggaaatttgccagtaaaacaggtcgccgccctgcatgacgctggcgccgttgtccgtaatgctggcttctgagtctgcgctgtagctttcctgcccagcgagcagccagtctaccgggtggttggcccactcttctgctttcgcaataccgacttcctttgctttagccaaaaaggtcttcgccagggcttccttaacgggagcaacatctgtcgaatgagcgataatatcaatatcgctggtaaaattattggctgccaacagcatgtataacataattgatacctcctgattacatggaaatgcccttttcaagcaaggcctcctgaagtgcagactggcccgcttcatcgtgcattatcatgtagatgacgtcttcttccgggtataatacccatccttccggatatcgttcgggatcactgtcggatgctttctcataaataggaatacatccgttcaccttttgcaagatgccctgttcgatacatttctgtacaatctccttggcgagaatgtagtacatatcgggtctcctttcgaataaaaaattctccctactatataaagtagcgagaattggttagtagttggcttgtataagcctgatgatgtgtaaaaattggatcggtcctttccaaatggattttggtgtgtttgtatgggcaaactcctttctgtgcatagcactcaaatatgtatataaaaaaacacctctactagataactaatagaggtgttataagcaaagagggatacaataccacagcaagaagctgaggcaagacgaacattctcccaaacggagaaaaaagagactttatataatgtataataccatattctctatgtgtttgcaatacaagcagagaaagtttcgcggttacacagatgaaccgggtgttacattatcgaggttgaactcgagcttgatatcgtctgttggcaaccccatccgttcggcgtgattttgtgcatacttgaagcgagtaattgcctcgataaaaagtttttcgtaaggtgtggccttgctccattgcacgttgaactcccggcacatatcgaagaaaattccatagaaaatatcgggttctccgctgcaccgctcacagtaccatttcacatccgaataaaccggctcacccttatagtttgttgctggcatatgagtcctcccttctgcccatcgtaaatctcatatatcatttatagttatccatgttagtttaaagaacgatatttatgtggcagaggtatgtcagaaggtaaacttcgggacgtattttttaatcatctcagcaatgcgtttgtccgagccttcttccagcatgaattcaccaaagataggctccagataaaaagccttgcacagcttaatagtgtttgtgatagcggcttcattgacctgatacttttcgctaaggtcacgaagagatacaccagttccccattgctgataaatatctaaatgactagacatggttttaaactcagtgtgaatggctgtaaaggtgttatcgtcatcgtactcattgtcatcgtagatggagatatccatttttacgcctaacagctcgctcaatgccttagctgttttcgcagcgtcaactttctcatgccgactatatattacaaaatattcagcggaatggaagcaagcgtttaagaatgtccgtgaaagattgaactcatgctcccacttgggaataaaactgatagttgctccgtgtggatagtatttattgatgtgagggcaatcgtgttcatagttatcccaaagggttacttcaaagacggcgttgccaggatgctcactaaagaaccggttttgttccgtaagagtttgcatccatttcacctgaatcggcttaggatccgggtttgtaagccaggtatgagtagggtaaagccattccacagggtccgagccatgcacatctccggtagatgcagctacagcattgagaagttcttcgtaagaggaatagtagagatcctcaaggggatggccttctgaatccaatatcagaaatctccacttgtcgtcgtagcagaagcagacggaatctggattggactctgtaacgaagtcgttcaatgttaatcctacatacttcttcaatcgaccaccgtagagtatgccgttctgatccatggccaatagttttccacccagcgaagcagataggccggcgtttttcccctcagacaataccgtcttgaaaatatagtccatgagttcaaaatggctatttacaaggccggcgatagagagggctgcctcgttctcgtcacacagataatcatcttccatggggacgtcggtgccatcttctttacgccaaagaattcggggaccattccgcttgatatcatttatgtagtctttaagcaacgcgagctgcttctcaatctcctgcgacataatccgagcagcgtcctcatcccaggaatcaatatcacaggaaataccaaagcgatcatgaaagcacttagcgataccactggctatttcttcgttgccattgcagtacaagatgaagaaatctgtagcgagagagtaagattcaaacagtacattgaaaatagtatctgaattcaaaatactatccggggataatttcttcatacccactcccctgtagaattcaccttgcagatcaatctgctccagatggtcttccgggcatatatcggtaatccaaacagagtcatttctatgctccgcaaggaactgattaaggtcctcggtattgctgaacagctttaaggtcggctgtttgggtaatgcatgagtagtgaagatgtttgttggcttataccaaggggttggcttatcagcctggatattgggcaagcgcagcaaaaacgccagtaaatctttttctgatgtaaaatgataattttggatagcccaaccgctattaggacatgtgatttctatatcccagcagtacatttcatttacaccataaaccatatggttgggtgatgaaggagttagataagggcctttgtaaccccaaaatctttttaccgtgtccccgtataaaataccatttgtatggagtgcagtcaggtcctgaatggctttaagaatagaaggctgctcctccggatattgagccatgcgggccatcatagcatacgcggccactctcgagcatccggtatcgtcgacaatcttctgtgcggaaaaggaagcgcaaatatagggctcgttttccataagatagaggtcgtcttcttcggaagagcagaactcgtaagcgatgtcggtattctgcttgagcaggtttgcaactgcatctgcttcttttcccgagtagaggtagttctcgtaaatatggtttgagaggtcaaaatcctctatttcttgtttcttttcttggtcagtcataacttacacctcatgccactggtcaccgtcaaagtaaagctccaacgttttctcttcgccataaagcagagcgcgaagcgacaggtcaccgtcatccgcctctacgacgtatacaagaccgccgaaattgttctgatcgtagtgagcatagcagtcatggtgggtcttatcgattacagcaccgagaacgacgccgtacgcatgttcatcatcattcaggtcatccaacgcgagcgggttgcctctgtcgaagcagacgcagttctcgtactgttcgtaggttgcatccgtaaaatcgacgatatcacggagcgctttcttctggatttcctgaagggtaagcattgcagaaatagtgtcaaggttaatcatgttctttctccttttctttgttcaattcttgttcttttttgtgttgagctgcgagaacagacagatccggggttaatgccttttctgcggcttgtgggaacatcagtttgatgacttcgagtgctctgtttctctcagagatgttcagatgctcaaagatcttcgagatttggaaggcttcgaaaaatacaccggattctgattccatatatacatcatgaagatgatctaagtattcttctttttccttttcgacatcaattccgatggagtacagatattcgtaataggagtctcggctatccatacatgattcggacaggatgttgcaggtgtctaatgcattacggacattggattgacgctcatcagatagtccgaggaggtaatccacttgtacggctaatgccttagatagtgcgggcaaagcgttactgtcaatagcgacttgtccgttttcccatacactgatggtactctggacaacaccgactatatcggccagctctttttggctcatacccatctgttttcttaagagagcaatacgattgggtatcgtcttcttttgttcatttttcttcggttccatttccagcctcctttttaatatgcgcatttggcgcatattaaaactatgtaatgagaataataagtcattcatcctgttgatggtattatagcatcttaatatttttatgtcaataattatttgcatagtaaatattataataaaaggtatgcgcggaagtaattcgagactacgccgctgaatgaggtgaatctgctactgcattcattaaatgaggaaacgatggctcgagataaagagtttttcgagaaaaaataaaaaagccgctccgagtaatcatactcagagcggcttttcgctaaatgcaataatgtttaacaataatatgtgggttctgtgttgaaatgcattttccacgctgcatggatcatgaagtattgtgcagatatagcgtccatcaatttgttcagatctttttgagggattccgcttttgttatgagccaagatacaggctccggtatgtgtaatccatactttggttgcgttagcttgaggaatacctatagtaatatggacatgaagaggctctccattttcatttgaccagaaataaataatatattggccaatacggaataatttaggcacttaaaatgcccccattttctgcatatcgaaagattaaatgtgcattatgctgcaagaatgtcttaaagaaagacatctctgtgtcagagaagccatcacgcataagccacttatacgagggaagttcacatcttgcggaatcaaatccgccttctttcgggcgctcgaagtggacctgaactgtcttttgtccatctttctcaataatttgagaatgagtgactaatgttttatcggcgagctccaaatattcatacatcatggtgtctcactcctttagtgtaataataacatgtgatgcttcatgcgtcaacagctttcaaggggactatccggggttcgaacttaacattcggattgtcagtttctgcaataaccaacggactgttagggaattcgtttcgtcgttcccttacgagagcgtagatttgggatatagacattccgtgtggaacacgaatataatatcgcatccttaaatttcctcgagagtcaaacgaccacaaagtaattctgtctttcaaaccaacacctctcatgcttctgcatcatgttcggataaatcgattacccgaatggagagaacgctgtctgcaaggcggtgtagttcgtcgaacccgagcgtaacgtaatccgtgatgccctctcgggaggaacagaacatccgcacctgcgtatacacatcctccattgatacggtgtgatcgtcagtgagggacctcaagaaagatttcggattagaggaaatctcgttcagcacatcctggatgtaagttccgggatctaaggcagatttgtctgcggtagtatattctttgtaagccggaaaaatcatgccttcttcaaaggcgaaaatcacctcgacgccgatttttgtttcatcggaagtatgctgcaccggcagagcgttcgtcggtttgaacatgggatgctccggcagataatacggcagcaagtagagcgtgccgtcctgccgctcgtcagtttccttgttgaccagaccgcagggcataacgcccagaactgccgacgagtcgataattttcttggcttcggtctcatcccatgcacgacccttgtcgatagccaagccactcttataggtatcttcagtcagatttttctgagcaatggcatatccgacgtacggggtaggacgtttatcgttctcgaaagtgatgccatccatagaaggcagagcttcttccggcacaacagataaaacatcagaaaaaggcttataggtgtattctttcatagtacgtttctccttgtcatactcataatatacctgagcaggtctcttattgcaagagacccgctcggattttttctatgggttattcgtcgtcctggtctccagcttcggcgtaagcatcgtcaaccagcagcgtgacctgacatttggggcaaaagtctgtgttctcgcagaatgcgcagagtgtatctcgtgcatcgcagatttttgccagataatctttgtcaatcatgtttaatttcctttcttgtggtgagcagataacccgctccatattctttggcgattttagccagcatatttgctcgaacataccaatatcctgcatgggatttttggccatcggctcttgcaatagattccaactcatccgcagtctctcggctaatgatagccttctgagcagcgatgatgcctgcggcactttctacggaaaggcctcggatgataagatcgctgtctcttgcttccttaaaaacctctttgcggatggtctttaggtgagcaaatagttttggggttgcactcatatctttgcctcttttcgtgtgttaatgccgcaccatcttaggcgcagctagtgaaatttcctgtggctcaccgttcaccataccgatgcatttagcaataccggcatttaccaccaaccggcggcaaatgatacagggcgcaggatttgcataactgccgtcccgttccagcccaacaatgtaaatggtgctaccaatcatatcgcttctagccgcagaaatgacggcattcatctcagcatgacagcttacgcagagttcataacgttcgcccttgggaatattcaacgcctcgcgctggcaatatccggtgtcgacgcagttagccgctccacgcggagcaccattgtagccggtagcaacaatttcatcgttgttgacaattacggcgccatatctgcgacgcagacaagtgctgcgtccagcaacagcttcagcgatgctgagataatattggtctttagatatacgcatgtctttgctcctgttcaaaattcaatgactcatcgggatatatgcccttgacggaatatcccttttcttactataaaaaagagatagggcttctgacgagcagatgctctatctctctgagtagtagcgttaccgcatttgcactttgcaacacgatatacgctgaatggggtatttagtttgcaatttcaagcaccgaaaacgcagactccgggcacttatacaggttccgcaggttatcgatgacatcctgcgaggtatctgcatggccgttccaaacaacaccagggccgctgaagtcaacccaatcatcctctgcttcttcgtcaaacgaaggctgagtaggtgcattgtaaatctgtgcatcgcgcagatactcggaagatacgatggcgataaagtgtttcataaagaatgactcctttcagataaggtcgtggatggtatcagtggcgtcggtatagctaactacagatccgtcgatatccgacagttcgccgaagtctgcctccgcatacgccgtggccatagcctttttgatggtttcgggattcgtatccggaacatcgatttcggccgtgaaacgaccttttattttcatagtagaccagattttcatatcaaaaaactcctttgtatagaaaggttgaggaattaaaaattattcggagagcacaatagctacaacctgatcgatatcatagttgttgtcgatgagctgcttgttcagcttcttccacgaaagaaaatgtccttcagaatgcttcgctttacctttcttgatgtagatataaaggttaaacgcatagccatctgcgatctgagcaaggccctttcgaagagctgcttctttcgtcgcaaatgtctcggtatcggtagcaacagtcgcaccggccatcgttacataatccaatttgtacataaggtatctcctccgcttaaccgaaagttgtgccgtcgattgtgcaaatcaggcggacgatatcataattctcaggcaaatacttgaggtatgccctaaatgcgtccatgaattcggacacaatatcgtcaggcgacgaatatgctcgtgagaacagtttcggctccttaggaagaggccaatacatgatgtggtcatcataaaagccggactcgtggtattcacgagaaaatgcacgttccggtgacttgtatgtctccatcacttcatggtttgtttcagccgaaccttcaaacgcggtaacaaactgcgttttgttagtgttggagtctttctcgaaaataccgtgcaacggctcatcgtcgtagaatcctaccggcagagatccgcccttagcagcatcgatgaaatctgcatcggacatttgcaggattttttcctcctcaggagaaagtccgtactgctccgggtacatttccatcgcagctttgttcagatatggcaacagttcaaccagaacaatgccaatatcgtacatgggataagtttgcatactcataattaaaaactcctttttgataactagtgggttggtaggtgtacaaaatattttgggattttcacgtcctttcctgtgaatgaccaacttggacattcactaaatagttaatatatataaaaagtccactatcagatatctgatagtggacttgtaagcaaaggtaagaaacagttctcgttgcgagaacaagggttacacatttctcataattgagaaaaagagggactgttaatacaattatgataacatatgaccgatggatttgcaatacctcttccctgccaaggtagctaatttaagcgaattttatttgtcgagagccaatcggcgtctaattaaagtaagtggggaaatatttgaataaggcaaagaaaaaagcggctccgaacaaagccgctttgtaaatggtggggcaggttggactcgaaccatcgatgccggcttcagaggccggagccttaaccacttggctacatcccaatattgtggcaggggcaggacggatcgaacatccaacctgcggttttggagaccgctgctctaccagttgagctatacccccgaatagaaaatggtgctgcttacgggatttgaacccgtcttttcggcttgaagaaccgatgttatgccgatagacgaaagcaccggagtggtgatctgtaccggactcgaaccggcgttccagccttgaaagggctgtgtcctagccactagacgaacagaccatgtgcaggagattgactcctgcgttcaggcaactactgagtcgaggacaatgatatcgtccattcgtacattcagtacctttgccaagataacgagattatcgacagacggaagcgatactccgctctgccatttgtagatcgcttgtggcgaattaaagccaaaaatcttttgcagatccttaaccgacagaccagttgcctcacgcatggctgcaattcttgcgccagttaaagcaaggttgatcgttggcatatttatcatcggaaaacatctcccctcttcagaaactatgccgtataaggcattaaaaaaaccgctcgccttgggaatcaagacaagcggttaaatcatcagagggaaatgtctgcaaattcagacatccaatccgagcataaatctctgcttatctcgatatgggcgcacttcaaccaggctatattcgacctgttcgacgatagcctgacgttcgctcatataccagatagcagcagaaatcatgttcatggttgttttggtcctttctgagaaatgttcttctcttgctctgtacttattatactacgttaaatgggctttgtcattaaacctgtagttgaatcgaaaatatttttcggcatggctatagacgagtcacagaaccgatacatcttcaaattccattgtttcagtgtcaacaatccagcctttaagcgcaggttcgaacgatgtgcaagcacaattcagaaccaatgtctgcccgatgtatctggcacagtggttttcgtgtatgtgcccacacaaccagagttttggctgggtggcttcaatccagcgtcggacggcgcgactaccgcaatgctgtccattgtacaggagatcgcctacaccgaatggtggagtatgagccaatacaatagtgttgctgtctgcatggattttgctgagttcgtacgtcagtttgttgtcgtgcgcttccctgttggtcataaatggtgtcgttgaaacccactcgaatggaataagcggatactccccgagcattgccggctgaagtaaatgtcggcggtcatcgctctcgaaccaatcatcgtttcccagaataaaatgtgtatctatagccatggagtcaagtattccgtagaaatacgctgcgtcgcgctcttgagcagaggtgaggcttgcgatgctatgaggctcatggccgtagccgcccaggtctccacaatataagaaagcatcaacatggttggttgcagatttgagtttgtcgaaaagttcctttcgtccatgaatgtcggatgtgcaaaaaattcgcatactacttgctattctccattcttagatttgtgtattttcattataccatatttgtgacgcaatagaggaatcttctgcacaaaaaagaggagccgcatatagcagcccctcttccgaaataaaaaggttattcgttgtgccaaccggcattatgatcccatacctgcatttttacgcagttgggttcgtctagtgtggcgaggaagtcctgacgagcctgtcgggacctgaacgtcaaaatagctttttgtcccgtgatcttaggcaagaggccaaattggccattcggcttgagggatttctgcatgcaccagtcaatatccatagtaagcggatattcctcctggagcatcaacaggtatttgttaactgcatttctcatcggagtcatttcgcagtcctcccggaacttccctgcacctcgctcacgaattctcttcgggaaaaggctcggggcgtcaatgatttctttctgcaatttttctcgagtgttgcagaaaggcagcatttctgcgaagcaggtgtggtagcgggaggtatactggttcatgcggtagcagacaaagccctgatcggctactgccttatacgcattgtcgatatacaacaacacattgtccgctgctgcgatgacctcgctcaaggggaccagtcccgagggttctacattcttcttgttaataccattcattgtacattaactcctttattcgtttcggttaaaaataaaaacacactcaccaaataagaatttgataagtgtgtaaaaaacaaaataggacagcatcttctatgagacaaataaacaatcacagagaaaactgtgcaaaagagacttttaatataaacatattatcatgattcaaggccaaaagcaagggcttcgcattatgcgaagcccttgcttttttgttaaacagtgtacttttcgtgcgacacacatccggcaatgtttgttgccttcggagtgctcgtaccaatcgcatatgtaatatcgattggataccatttatttttgatacacactttgttccatgcgtgataaacgccattcgatgtgtatcccttcacaattttgcaggcaacgccctgactgcggcacatcgtcgcaaacagggacgcataatcatagcaaataccctttttagtggcaagagtgtttttcggtgagggtaagtaattctttaccttccctgctgctacactattcgcgagctgatgatcgtaggtaaagccaccgccatcaaggtagttgtaaattgcgaccaccttctgctcatccgttttggcggtcttgcaaagtgcagaggcctgcttgcagacggtatcaccggcagtgaacggggcttcgactgtcgagaccttgtatggtgcattcgaatctgccatcgtaacattaaccgtatgacgctccacaatacgatatgtggtcttgttgatattctgatacagcgtaaccgtgtagacgccgttgccgtatgtcagtggaatatcagagtgaccgctggtgcagtccatgtaatagcgaccacgaccgtcacaggcaacgccaaccttcagacgcttttccgaactgtaatgtatgcaagcataaccgttcgaggcagaagagaggtcgataacgtccgcgcttttagcagcacttgctacgctgatacttgcagataccgctataaccattgcacatacggtgcgagcaatgtgagcggcgatattataatttttgttagacatgttaaattccttttaatgtattttgtttcttttgcagacagtaagcctatctggtgggatgatcccctgaaactcgtaataaatgtcagggggtgcatcttgtatattgagatctggaactaaatagagcccgctgcagtcaacggacagtaaaatgattccgctattgtaaataacatcaggaaccatctcagaggtttctgccatagcaatagcacaatccggattgctgctcagataaactgtgcctctctcagattgactccaatttttgtgtggagttaaagccccaagtccgcgttcgaggatgctggagagatacgaggcataagttgcatgatacagcttcacgtcaaactctccagcagagcattgagatctgtatcatcgtaatattcgtccttgtaaaccgccctcttctgttctgcgagcagatagatcaggtcacggaaggtgtcttcgtccagattcagatagaagtctgaggagaactccaccttcgacgtataaatgattgcatcgacaagattagtacgtgtaaaagaagcgtcatcgttatcaatgaacgcactactaatacgtcttacgagcgggagcatcttttccggggcgtatttccgaggacccaactcgtgtttgaaatggaaaagcatgagcgcttcttcaaaagctgtgtaggagcttttatccatctcttcgagaatattcgtcatcaaaaggaccattttatcattgttatccattgtgtattctccttttaagccgtcgttttttaccatatcatccttacggtggatgggttagttatcgttgtcgcaatagcgtttaatggcagctctgttctccggtgtatccagccagccaagataacgccggtcgaagttaatcggaagatccgctacagggataaaattcatcccattggcgattgcaaccttaacagcttcagcgtcgcattcaaaagctgcgatttcgtcaatcgcctccaactgaagcataccagtaccatcgaagtcaaaaatgccatagccggcgtttgtctgatcgataccccatccttcgatgatttcttgaatatcgtcatcgttgtaaccgatgctttggagctgtgcataacgctcatccgtcaaaccaaaatttttcatagttactcctccttgcttttatctttgaagatgtcaatatcgaacgaatgagtgtagtcctcgttgtctttatcagcaaagacacggacgcggataccctcgtcgtaggcaatattctcaccatcgacatgatatttctggccgataacggtaaggtcctgaaaccaggcgccattgctatcttccaaaccaacatatacttctttcatctggtcgttgccagcttcaacaaccagtgaggcaaatccgaggtcaattttgattttcttgttttccatgataattctcctatctctgtgtaaattcttcatcgaagatgttgcatgagacgcaaatacgtcccagggcatcagtcccagcacgcatagctccctgatcggcgaaaccgaccaaggtcaaactgttcgagcccttatgagtatcatcttcaatggtgaaatagtcccatccacgagcagcagcctgctgacgcagatagttatttgccttttcatgggccagcagagaattaaccctattgatttcatccgcagagtgaggtgttccgccagcattcatttcgagataccagcgaagaacttcctcttttgtaggaagatcattgatgtgaatacgaacggtatcgtcaaccgctctcaacgagtcttcgtaatccttatacagagttccgaaagccggaatttcactgtgaaggaaacgaaggatagcggtaattcgctgaaggccatctacacagacgtaatcggtataattcgatacctcgttcttatgatggatctcggggtagttgaaatagagatcacgacccgtcttgccgccacgcaggaggaattcgatatacgcaatctgctgcgcttcggtccagacatgaccacgctggaaatccgggttgagctgtaaccctgcttcttcttcctcttctttcagccatttttcgaagtacgaaagcggataatccacctgatagtttgctcgaatatatcgaggaatgtctcggaatttgttgtatttcatcgctttggctccttttcaagcattattgcgccacagtgtgggcattcagatggaggattgctaacaagatctttgtcgagcggattaccacatgccgagcattcggtccaataaacccagtgcaaattctcgcaagtggatctatctaaccaagccgcgtgctttttgcctttgtcgacatacggttccggccatttctccagaacttctggatgccatctcttcaagctctccttgataagccgcaggcgttcttcaaaaaacactttgtcggataattcgggatcgcttctataacgagagcggaaacgtttattgtgaaattcgtttccgtatacccattccacaatggcagcatcacagtcctcctcgaaggctgcaaagtgctgttcgtagtccatggcatacttgcgataaagtgtgacttctgtcacatactctcgcaaaagcggtcttacttcaatatcaacgataatgccgccgtgtctgggtgtagagaactcccagatgccatcagccaacttgtgctgatgatccggtctgccccacatctgcgaagccagacgttttgcgatggtggaattacttctcatctgtatcatctccttctcctgacggttcgggcagcatttctgcaatataccgcagagttactgtctcacctttcattaagtcgaaaaaaatgtcgccaacattaaaaaacgcccacttcccgttcccggtgacgccgatataaaaatcgtcgccttgacgttcacgatagcagtggactgtttcaaagccgtttgcaatcagtgcttgtgcaagaagctgatccgactttgaccaacgcctttcaggtgggagtttcttccgttcttggatctcacagaagtgggcaacagccttttcaatctcatctttcgtcatttttggttttcctcctttgtgcaaatacaatattctcgctggttctttgcacagccaacgcacttatccgggacataccgcatagccaaccaccttgcagctgcttctcgcgagctgtaagccgaaatgggtttgtagatatctcgaatcgcatcgattaactgtgcaccagaattgcgacggattatactgcggatgtgttcctcattcgtgggtttgtagaactcaggctggccgtatccggtgcaccgacgttcccaatcctgttgtgcctttaacttggtgttaaaccaatcaccacaggaaacatgaagcgctgtatttgagcagttgtatttgtacgaggctttgcttgccctgtctggtttgactgctgaaagttccgcttccgctccacaaatgggacatgcgctcagatggattttcggcaatttacctttgtaaaggccgttgagtttcagggtacgaagggcagcatattgtgctggtgtgacttctacatcaagaacaaaattctcccaaacgggtaagaatccgccgttgaccatatgaagccagtgaagataatttgcgtagaacgcttccgggcaggcttcttcgagatcttctcgggagagctgcatggcctcttgagctcgtgcaatcatgtactcctgatgagacggaatcgcataagcgattccgccatcaggggcaatgacaacttcgaggtcgtgtgtaccatgctgctttttgtaagcagcaatatcaaagctcattatcgcaccttctttcatcgagcattaaatgcatcgatgaccggctgcgcaacgggaaattcctgaagcgttccattcaggaacgtgatatcagaaatccgtaccgccgaaggcatgatctcgttgttctgctcatcccagcagactacgtagaactcacgcagctcgctagccgatgccagaaagtctgctgtgatatcctcacgttctaaacccatctgcaggtactcggtcgtatagcagtccgagatatacgggtctttaaagtatccgccttcgcccgactcgtaatgacacttgtactgggtgtcattgattttctcgacgtcacagctggtgacgtcgaagtcgaacggaataccgcgtccatttacgatggcgaaaaatccacctacggaaatattgtcaggatgggtcacaagatccagcggctgcggcagagtgatctcgaagtcggcactcatataaaccggatgtaactgtttcatgataaaaatctcctttttttgtattactggctgttgttgacgatgttatgaagaagtttcatcgcctgttcttcacgcatatactgtgctcccatttcgttattcgaaaggagcgccgcaagaagcgcatagtcaaggacgtaatcagggtcatgaacgcgatccggggtaccatccatgcaatgcatgatgctatccgggctttcgccttcaaggaccaaatcgtccatctctccatcgcgattgaggattcttacatccgctgtattattcaggtcgtaatcacccagataaatgaagcggtgagtaaatgcccattcgttcgcatggagcagagacggtgccgctcttacgacttcaaaatcagtcggaagaacagggtcggtggtacggagccaaagttcaagatcatccgaatacgaaacccactcttctgtagagtgattcttcatctccgggacctgatcttctccaacgtacatcttatctctatacgagtggagaaaggtctttgcctcctcgtaggtgctgaatgcagcaaccatgtgttccagagcatggttttcgaagatgtactctgcaagaagtctgcgagtatcatgatcggtcaaccgctgctctacttcgtagatcgtttctccgaagaaagaaatttcttctcggagatcgtcctccgaatagttcgccagattgactgtatcaacggcaacgccatatccgcaatcatctggtagctggcaaatctgaacgcacgcaaacgtgttgcgattcactgaccggatatactgttcacagtcgatgtctgtcagaagccatgtatggcgggagttcaacagcgaggtccggcagccgtaaatagcctccattttatcttcctcagatgcagagggagacagcaccaggtccgctgtgttatttacctcggcccattcttccatatcagcgtctgctgcaaggagaatgattgcgaggtcctctgccccttcataattgtgacgggcggcaaacacctcttcgggggcgttgcagattttagccgaaatggctttacccagcgactctcgttcagcacttgcggggccggcgagaatcagattgatttttgcgtgtttcataacagaaacctccttgaaatgaataattatataaaaaaacacacctaccaataaaaatgataggtgtgttgatttgtataggtaaaacaattctcttgcgagaagaaaagacaagcgcaatattgtgtgcgcgaagagagacatttatagtgttataataccatgaaaccctgaatagtgcaactgcttatagtgattttgcgcttggatttttcctgaaaaacaaagacacgcctcaaaaggcgtgtctttgaaaggaaaactcaaaaatgttctatcggtgatattgtgagattttaacaaaagcaacaaaatcagatacatcacggggagtaaaacattcattgaataagtctatccttttttataatataacacacttttcaaaataatgcaaatcgtaaggcaaaaaaagaggagctgcggtagccgctcctcttttggtaaaatcgattacattgagttcatcttaagaacccaaacttcaagatcgcagagacacatttctcctcattctccgtcatgggacgaagaacacaccatcctctgtctgccgtgaatgtttcccaattatcgttgtgtggaattgcggaaaaaccaacagggttaaccactctgccaacatcgaaaacatcacgttcgacaaaagaaagtgtctcatctgggaatgcgaatgtatgagtgcactccttctcgccatttttctcatgaataggcgtgcaggtccaggaaacaaattgcgctttggttgcctcgtactgcttctccaattcagcagcatggctggctgcttctgtaatagcgtctttctgctctttggcaatagcacgctggccgttcagagaaaggtagttctgtgcttcttcatcgctgacgatccatgcacggtttgagtcgccgagaaaagaaccatcgggatctcgatgagacacatcgtcccagctgatgtgcggcagaggcgtggtctcaagagagataaaaccctgctcacggaaccattccgcatagtggggcttttcctcttcggtaaaccggcgagctttgtgcaaactgaaaccatcaggaaaagattgtttcaataccaacataattgcatcctccttatgattggttatattataacacacccaaagtccgctgtattggactttgggcatgtgcatttaagaaatatcttgttttccccaacggatttcgaaaacaccttcggagttttcttctctccgcatcagggtttcaagtagattataatcgacgccaaaggttttgtaaatgtcgtcgaggtcttgttcttgtccacgcatgaaaagattgatcttttccttcgccaaaaccatctgcatctgattagactcaatactgccgaggtacgtcacgaagtaaatatccttgtcttcccgcgaggtgtatcgcacgaaccgcatgtagaactggctcattcgagagttgttataatgcagttccgggatgataaccttgttcacaaactcaaagttgacggaactcggcaagctctgctgagtacagagcaaaataccattcccgctcgctttcaatgtcttgcggagtttccgccgctgagcaagtgtagtggtatcgccagtgactacaaacaacgggcgttcaggcatcagctttcggattgctgcggaataagcatcaaccacctttttgtggcggacaccaatagcaataatctgatccggcatctcttgcagcatttccattacttttgcgatctttaccggcatgccacccgtatactctttaacagtatttggcgctgcactgatgcgaagaagcaatgtaatctgctgaatgagacgcatcatgctgtctttacgagaattacccgtggaagcaaagtaattgccgcgcatcgcatgaaactcgctaatagccttctgatatacctctttttcaggttcagagaaacgtacaggaacctgatggatatgcttgatatctttgccagtaatctcctcgaaagttcgagtaataaccgtatgtgcaaggatatcattgagtacatccgcattgtagatatcctgcgtccgctgctctgcgccaaaaacagtaatcttggccggaagatgtgaagccgaaaacaaggaataaccctttttatatgcagggattggccggccgtaaaggatattgttatcctcatgcagaccgggctcttccttcttggaacctcggctgaaacgatatacagttttggcccaagaaatcatattgtaggagttgttatacagcatctccaactgcggtgcaaactcactaatgttgtttcgggtcgtcgtgcccgtcattaagagtttgtacttgcatcgacggaagcaactcaaagccgccttagcgcgtttgctgtccggattggccatttcgtcgctttcatcgaaacagaacgcaaccttctggttgtgtatacggatccatctcttaatctgcttgcggtatttgcagagcatattaagggttacaaggacgaaatctccttgctggatcttatcaacatccgcagctttattgatgatggtgtaagagatgtcgtaattctgcagagctacctcccatgtattcttgatggaaatggcaggagaaataacccacgtgcagaaggcattttgccgctgcatacggtatgtgcctgttgcaatgccggctaatgtcttaccacttccctgctcccactgaattaaactgtactgtttctgcaacagcaggtttagatcgtgtttctggagcgcggtaaaatgaatgtcttcatcgttttccgcatcgtgtagggtgaagtcatccagccaacgtgcaagctgctcattctgctgcatatccgaaaagctctgctgctcagtttgatagcatctttgcttacgacggatcattttggtgaagtcaccgaaatggtctgctgactggttatcagctacgatatccgagatcagcaccggctgtttcataccgggcgtaagctggcgtgccatttttgggctgtatgccttgaataccagcgtatctcccctcttaatgcggacgatcttatcctcatatttgggtttgtgctgccggcttacagtctgcttcagatatgccaggacttttgcctcggtgatgcggactcggcaccactcttcatacgacatgttttcgggttgttgttgtgtgcgcagccgttccacatactcgcagcatttgccgtatttttcttgaaggcgtggatgggatttaattgtatacagatactttcgcaccttgtacacgaaatcacttccagcatcctcttcccttgccaattccagcagaatgctattcttcctggaacggagctcagcttgtgcgttggcaacgatgacttctcgtactttggcaaccatcgcatctgagaaatccggaacctcaagtgtcattgcagtgctgtatcgttgtgggcgccaatcttcactttgagatttcttctgccagaactgtgcttttgttgggaacgcatcaataccaaaaggtgcaaatacggacagaggtaaagaaaactgtcccagaaagctgaagtcgttttccatctgttcaatcatgtgtttatcactgaaagtatcagctaagaaagacatggggacgatgatggccataattccaagaggcttcaagacctgagctgatttctggcagaaatacagctgcgaaaggatgctttcattttgaaaattaaaggccaggttaaaaggcggattacccactgagtagtccatcttcatgggcgactcgtaattgcggatatcccctctttcaagattggccttgggatacaggtaatgcgcgactttgtaggctttggggtcaatttcacagccatagatattttcctctacaggcgcgaaattaaagaaattgcccatgccgcatgtcagatccgtcacgagttcctgtttgttaatattcaggcaggccattaaaaactgacatacgctgtgcggcgaaaatacctgtccgttttcgatttcttttttcgcctgagaaaactcagcgtaattgtcgaaatcagccatatgaagaccgtgcaggccgccgtcaccggtgtaggcgttgtagatatcttctctcgtgatgccagcggcttccgcctgattgctggtgacgagatgaattatcttttcattcagctctttgcgagcctctttcgggatgcgttgtcccagataagaatatttcatgtttttctccttatattgatagcaggaaggaataatatcccttcctgctccatatgtggcgatactatcggattatatgttggcttccaggaacatctctacaaactcacgcgcatactgttcttttgtaaaacgaatatctacgcgcgtgttcttaaagcacttgatcgaggctactttcgaagagttgatctcgataagctgctgagagaattcgtaatcaagcagcatagtatactgatacggcataatggatgtctggccgtattcgtacatgatcaagcctcgaacgatgttttttgctcccgaattaagactgaaatcgccgctatactcgctacaagagcagccatactccaaagagataacggctttcttctggctgtatgttgcctgctgatgcatgtatgaatgatgagcagcttcgaagcacttgagtttaagttcgttcagcgcacgttccgcaaaggtaaagccgccgagctgaacaatgataagatcgagcacatcttcgtaccgaatatgcagcgattccatcttttcctcgtattgtttatggtgttcgagattattgtcataataatcgagttgaggaaccaactcatttcgaattgcatccttagccaactcaacatgatatgtgttctcaaaccaacgcacaatatcgtcgatgaaaatggcgtgaatgtctcgcagacgatagttgattttgttgatgctgtaagcatcccccagataatcggagattgagccagacggtaaattttcgatagcgcttttttgcgctgcgatatgtatctcctccatggatcggagctgcttgagggcttcgcaggccttatcgtatgctccctgcataagaaggcaagcgatattatcgctttctgcgaccttggatgtgacatccacttttacattgccgaatttttcgagcaaatctgccataaaaaatactcctttacagaatagcggagcagtttgaagctgctccgctaataatttgttgtttgggtggttaattttccattgcgtcaaggaactctcgccacttttcatcgatagacgaaaagtgcatatgagagatctggtcaacggcatcggataccttatgcaggggccaccctttccaaccgtccataatattgacagcggaaaactgctgatcatcaaaattgatgtaaaatgcgccgcatactttgccggtgttcatcattcgaagggaaaccaacgagtagaattccttctcagtgataggaacgaggccggcaaatgccttaatgaacataggggaagcagcacggtcccgttcgccaagataagcgttcagcttttcggctacacccagaagttcatcgcccggagtggtcttgaagtaccaagactggtcggcttcgacgacatggtaggcggcacaggtcgtgtcttcgttgttcggaataaccgagcctacacgcttcattgcctcctctttgagctcccgcaggatggacagatattcttcgtgattggcgatgttttgaatgtgcgggttgggctcttcgtcgcagccaagggcccagaggcgctcgttctcgatcgtaccttcgatgtcctcaatctcattggtgaaaagttcgtccaaccagattccgatcatttctgtatctacacacataactttatgctccttttcaaaaatcgtcttgagtggttacgaattggccacaagggctgcgccgaaatcttcggggaaatagctgtttccttcggtatcgaagacgatatatccggcgtaactgctatcacccgagatatgtgcatcttcgccgcaggtaaactgcggatactccgaggagatggtttcgtcgcccttctttagttcgcggaacggaaccgccatcacgagcttgcccatgcgacggatagtcacactgacttccgggtcgtaaaccgtatcattgccactcgaggtttcttcggagtagcaatagcggtcagggtaaacaatcatggtgtaaacaccaccgaaggtataacagccatctgctgtctcctgttcgagatcgcacagcacagactgcacacctttgtaaaaggcagaaccagcagagcaaacgaaatcattctgctccatcaccgcttcgcggatgataccctgcgcgatacaagactcgccggggatctctaagaaggaaaactgttcattgggcgacagcttcagcaaggccagcatcttattgacatcattcgtggtgaatccttcgtcaagagggacctgcataaagactgcagcagggatattggtagtggtctttttcatataaaatctcctttatgtagcgacttaaagatgacggtacttttcgaataccagaatgtcgttgtcgtccagaccgtattcgtccatgatctcgcaaacacgttcctgcatcgcatcctcaccagagacacattcccatgtattcgcgccgttctcttcgtagcagataatatattccataatgaaactcctttcagtttccgaataatgtatctgcacccaactatgaagctgggtgcagattgtttttgttagttgttctcgtgggtgatgtagcagcatacgtgtgccgaatgctgaccgagtttaaaaccctttgcacgtttgacgatttttctagcggtttcgatgacatcccaagtttccttgggtgcatacattccatcgtaattggtgtccaatacgagagtaattttaccgtcagccaaatcgtacaaagtagttctacggccagttgcattacccagcttttcagcgaggcgctcgaattttttgaccaagcgtacatgagcctttcgatcattggcacgcaactcaaagaattcctttcgagtcaatgccgacagattgttggtggcatgcaccttataggcaagcgcatcgagttcttcacggttataaaccgtgatagcgtagccttcggcgccgcagaacgtcagcagcttttcttcctctccctcataaaacgggagtttctgatataatgccgagttttcgaccatgccgatttccttacgcatacaggtcactcctttcggtggtgcctaagaatgtttctgcaaattcgcgtgcataggcttcactggtgaagcgaagatcaacacggccatttttgaaacattttacgctgtccaacttggaagccgaaatctctacaacaggctcatcgaaattgataaaaagcatttcctgcatacaacgcggaacgaagtcaagcgtttcgtattcgaaatagcatgcagctttcagcacaggcttcaagcgttcatacaaagaccatcgatgaccatagtccgaaagcgagcatccatacgaaaaagacacaagagcctttttctgagtaaatacttgcttccgtccatcacaccatgcaaaagcatagcatttttccttcagctctgttaatgccttctcctggaaggagaaaccgttgagctgagcaaaaatatgctccagtacatcagaatagctcaaatggaggttcttcatctcctgggcatattctttctgctgaagctctgttggccagtccatatccaacttagggataagggcatcttcaatcgcggtgttatccagttccatgtggtaggtactttcaaagtagtgcacaattttctctacaaagcgattgtgcatcttcttcttggtatctcccaaatcagaaatctggatatcacccaagtaagagctttcgtacggactcgggttcaatggagcgagatcatctcgctgatggtcaaacgctgttgtcagaagaccaatcaggctggtcatatcctccagtgcatgatcatatgctttctgctgcgcttcacagaactgacgatccgtagtagtaattttgtcggtcagattaacctttacatcgttgaatttgcttaacagatccatataaatatctccttttgttagttgtgaacgaggcggaccttgttcttgggaacccacagggttacgttatggtcaccatcgatttcatcaatcgtggccaacacaacattgtcgcacttaaggacgggatcgagcaatgttccctgtgtgctgatacggacgttgtagtcatcaagacctaattcggcgctatctacagaaagatagatacgagcaccggcgggccactgaatgtctgcagaacacggtatgtgtttctttttcatgattttttatctcctttttttattggtggtgaaagacttggcttttgtggggtatcatctccttttatgaatgaccaacttggacattcactaattcgttgatatatataaaaagtccaccatcagacaataaatctgatagtggacttgtaggcaaaataagaaacagttctcttttcagggaacgaaagaaacaaatctcaaaaatgagaaaagagggacttttatagaaatataataccatattgagaattgctttgcaatattcttctgaaaaataactggcaagcaggaatagaaaaaagatcgccttccaaaatacattcgcaaagcgatcttttaatttgcaatttgtaattgagtgttatttccgctttagtctttgcgtacattacagaaaacagtccattcgggtcatattctgattttttgcaggtggtcgcagctctgatgtgccagatactgcgcagaatatacattggcgtactctgccaagcggttcagaatattattgaggagaaagtgagattatgctttctcttcaatatacttagcaaatcgtttcgcctgatacggagtaagagctcgtaccttcttttcgattttccattcagacagatgtaccggccactccggatttgcgcaaatgcttggatcaacagcatcaagcagtttcttctcttcgagttctcttgctttgatatgatccattgctttctttagatagcgaattgcatatgcgaaatctacctgagagccaccaatggaccaatggcctaactccttgctgttgatgacccattcgagccagcagctgttcatatatgttagattgatgatttcgtcggagtatacctcgaaatttgctcgagcaggcttggtgttcgaagaacggccataataccatgtgtctgttttttcgacagatacaaatacatgacgtgcagggtcggtttcatatttttcgaggatttcgctattttgaaatctctcgggtgtgtaaagctctgcttctatgacaaaaggacctttgaaggtagtgtctgtgttaatgaccttgtagcgtaccatagcgactggcgggtcgtattcgaccaaattggctttatagatggtacaatcgtcgacatggcaatcatgagtgcgattacgttctcccctgccgcgagaattatgccaagttcggttaatttccgcataggcagttcttccggacccctggtcatattcaggagtgagatgctgacaggttaagagcatatcgcccatagcaatattctgattgcaccgttcgacaatcttggtgaaagagccatatttcgagtctgcaatccaagcatcggctaccgcgtacttaacatattcgctctgcgtagatagcttaacgcccgatggcagcggcagaatgtctgtcctatctacaataccctgaagaatgttgtagataaacgtacgagaaaccaagccgtcaaggattttcttgcgctgttcacgctgcttcgcttcgaaggcttccttttcactttcgaaacggaattttttctcttcgtcaggcgccgtgtctacctctatcgcctgactgagaataaggtcatcgtcgatatgcacgcgtttttcgtctgtccaacccaaccaaagattttcaccattgcgaatgataattcctacggtttttccgtgataatagtcgtatgcgtcaatcaggttggcatacggcacatcatcgtttctatacagatgcttgccggtacgacttagacgaaccagcataacgcaccgcttatttggtgcaaaggtgtcaagagccagcggcgagtgcctcaggaactgctcaaacatggggatttcgtcccactggatgttatacaaagaagccagccggccgagatcttcgtcaaggaagcgcagtttttgatgaactatgattggctccgatacaggggccttttcgccatttcggatttgtgcaaaggttacgacctcaccggcatagcagcgaatggcgtaaatctgtgagtccaaaagatagatctgcccttcgaggcgatacttggtatcttccatctcgcgctttttctctgagagttctgccatgagcttttcctgcttctcacggagcttattctgcatagtctcgatttgagccttaagttcggctaactctcctgttttcgcgtgtcgaacatcgtccatcgtctgcttcaaagaggaaatctcgttgtcgttgaatgtaagcgcagactgcaggttctgtgtcgtgagggaattttctgcgtcaaccggaatgatttctcgtgcgtctgttgcacgaggtgccgataggctttctctgagttcagccggagtgatgttggaataatctttcggtgcaatgaggtcaatgtacttttccgggtgacaaatgataattcccttttctgggttacccatatggagaaaagcgaagttttcgtcataccaagcgccgacgtacaatggctgttcaaactcttccgagaatgagacaaactgacggaggcgatttactttttcggtaagctgctcagaccatacagcccaacgccgatccgaaaggaatccgccctgaatgccaaagaagtaattgatttgtgaatgaagtgaagaaggtttcttctctattacagctttgaacttatagcaaagatcccctgcttcttctaacgatagattgctataaaaagagatatatctgtcaaaattgtgtattttagcaatttttaacgcattcatgaaaatcacctcactttgatttcgttgaagttattatatcactgtttgatttattttgcaatatatatgtattttgaaatggagcagaactatgaatctgggttgctgttgtgagtatacatgtggtatactgagcgcaagaatacaaaggggattgcgttaaggagaaagcctatggtgcaaaagcaactgatagatgaaatcgtccggattatatgtgaattgagagatggcgatatcgatgagctagtacgctacgatttgaaattggactgcaataggacggaagagcacccgtggaaacggttgtgcagctataaatctgagaaggatttggatagcgaatgcgataagtctttacgaattatgataattttctggctttcctttggctttaatcgttggaagatccgtcgcaaaggagacaatttcgaactgcgtagccgagaagtcccgtttgttgtgcgtggagatgtcatgaactcgtatgctacaacagctcgcatatatctatatctatatcccgaaggggttctaaagaacaagcggcaaaatataaacgaacttgtgctcgagcaatacgataaggaaccaatgctgcataatttatatgagacgaatacggactttgcagagcttatcaaactttgtcatactgtgggcaatattctgccctgcccctccggagatctaaatggtgcacgaggaataggcccttcgaatgattattttgatatttttctgatgtgggttcagaagtatttcgagtacggcgaaggctttgcagcaggcgtttcactctttccgggtggtcgagagttcttagcgtatatcagcgactacgaagactttcaagattacattcgtcgcaatttcttgcaggactttgtcaaagagaagtctgggacaatggctgtatctcctctttggatgagtgagagcacaaaccttttcgagcaatttgttaaaggcgatcagacgctgctgccgataaatctcgagcagtgtacggcatactttcacaatgctggtgagcgtattattgcccgtggggaaaatattataaaagctgtcaaaagtcgattggacgagtacgagaaagctggtattgggtctgaaagacttgctgaagatatgtgtacgagagtatgatgtactacatacaaagaggggcaagaaaaatcttgcccctctttgtggtataaaggtaacttacagatttggaaagacattctcaaggacagaattgttctcaaaaaaccgcttgacaatatgcctctaccgcctcttccgtagactcggctacaggataaatatcctctggcagaaatggattcgtatccatttgaagatggcgcagctcgtggatggcagtttgcaaaacgcttttttgatgtcgaaagtcctcttctttttagacgggaggagtcagagggcccaaatatcggcgcgagagtaatcttcgaactgacgagcaattattccatatacaatgttccaattgccgccggcaaggccgcagcccaaaccatatgggatggcaacgcgcatatcgtctttttccgcgaattttactatagaagccagtcctttttcaagggcggcgtaatccgtgaagcagcctttcctgccgtagtaattctgatcgaagatattggcgataatgggtgtagtgcgctcggtttcgacgaacagcaccttgcccagcatacttgagggttcgggatgctcctggcagtatttcttgtacattgccagtacaccaggataccgtgtagcaatttgcttggctaatccagcgcccataacgccacggcagttgacctgctggacgataatgtctgcgccggaatgcagaatatttccgcttctaataggaatagttaacattttgcgatctcctttacatatttggtcttgcataacaccagctttgtggtggacgatgaaagggtttgccttcggttgtgcagagggtttccgggccttgtggcctgtcgtaaagatggaagaaagaaatccgccaaccatacagtggttttcctcggccgtaggcactgagttcttgcgaagatagacaggagcctttctctaatgcagagtagtttgaggttgacgagtcattgctggatataatctcttcgcaaataaattcgcctatgattttgccgttgcaacggtagattttcccttccgagtgaacttccaagatgtgatgtgaattgcgagtgtttcgttctgaacaatacacatacactttgaatgggagttcactggtggggcggtttttacggatctcaatgtttttcgctccgctgatgatgaggctgcaaaaacgtggcttcaaactgagtagaacagcgttcacataatcattcctttcgatttttataaaataaaagacacctatcagaatagataggtgtctttttaagtgaagtgatgaacttgatctttcaaagatcaaaatacggacaaacattctttttaagagaatgcaaaaagagacttcgtatgcatatattatagcaatttgacggaagaaaaacaataccaaattgcaaatgcaatattgaggataagtatgagcggtaagccgtacttgaaactcttatgcaaggtcttgtgatggaagaagtacattccgaaaatggcacctgctgcaccgccgaagatagcggcaataaagagcagcttttcggggatgcgccacttccctttctgtgcaaagcgtttgtccataccgaacaatgcgaatgcaagcacattgattataatgatgtatttcatgacttttgcacctccttttcgaaaaccgggcagttccctttacgcagctgcgactgcgcgtatcatttctttgtacgtggacatcggagaagtggatacatcataactggttacagcaccggaagtgtggtcgatgttcaaagaaagggtctttgtagaagctgccttgtaggtcagatatccaccgctcgtttttgcatatgttttatccacataaaacgtgttaaatgaaatgtcacctcgcaaatttgtgcagctagagaacatgtatatactattatccaccttatcggtactccatttatcggacgcataaatagtcaccagcttgctgcaattggcaaacatgccgttcatattagtgacgttggtggtattgaacgtagaaatgtcaaggcttgtcagcccgctgcaattggcaaacatataacccataccggttgcgttggtggtgtcgaacccagggacgtccagacttgtcagcccactgcaatattcgaacataccattcatattggtgacgttggtggtattgaatgtagagacgttaaggtttgtcaacccactgcaaccagaaaacatgtaatgcatatcagtgacgttggtagtattgaacgtagaaaggtcaaggtttgtcagtacgctacagccttcgaacataaagcccatatcggttgcgttggtggtattgaaattggacagatcaagactcgtcagtccattacaatcgtagaacatccgagacatatcggtgacgttggtcgtgtcgaacccggacagatcaagactcgtcagtccattgcaacctttaaacatggaagacgtgtcggtgacgttggtcgtgtcgaactcggacaggtcaaagctcgctacatcagggcaaccggcaaacataaaacccatgtcggtggcgttgatggtattgaacgtagaaaggtcaaggttcttcagtttggtacaatcatagaacatgtagcgcatattggtgacgttagaagtatcaagcaaagtcaaattctcaatggatgtgagtttgaagaattgagtgttatatgctgcgttcgagaacatgtgtgtcgaatcagcgttggcttgaatctttcctgttccattaccagcaataacaatttctgttcctgtgcgatagcaggtaatatcgccagtgtcatttacatcagccgtccatttttcatcagcgggggctgaaggcttgtaactatccataaatgtgattttcgtaatggttgttcgctttttagtagatttataccatgaagaacccgctgccatagtaggggcggttggcaatcccactacgaaggttgcagtagcagccgtggatgatgattctgcagtaactactctcgggatctttgcatcataagaaagatttaaagtgccactggaagaaatacgatcaaaatcagaggtgtcaacagtgcccgatgcgtccatccaggaaccgttaaaccccatagaaatgaccttggcaccaatagatgccgatacagcagcatctttcgttgccaacgaccaaccattttccgctgtgacgttgatggacgacacaaaaataggtgaactgccatagttgtgaatagctgcatttgtcgcagtttttacgactccgtctgaagataccgtaatcggcagcgatgccggtacagttgcatcaaaattcgcggcgaaagcagtaccacaagttgcagctaagaccgcaaagacgattagcatggctcgtttgtattttttcacaaaatatcttccctcttttctaaaacaacaaaaggctgcgaccaagttgtttagaactgatcgcagcccattaagagttgcgattaaccgacttgctgagcggtgagttcttcttgctcgggcggcaaagcaacctcttcttcggtggacgtattagtgttttcggaattattcttttcagaggaatcatcttcgtcgttcgaaccagtattttcagacgaagagtctgggagatcggtcgaacccttgctcgtatctacattctctgacgagtctttatctgcggtatcgttatctactggaacatcaaccgttttttctacttctaccagctcgtatacgatctgtgcagaaccgttccagttctcgcccaatgtcatatcatcagtgtttgtgcgaccttcgagaatgatgtactcgaggccctcacagtcagcaaaagcatccttgccgatctcagtgatttcccgtgggatgcttactgaatggaagtattggcagcctttgaatgcttcatcactgatagagtgcagctctgtgtctcccaccttagatggaaaattgaagtcaacaagagtatgttcatcaaccggaacatcgccattttcatcagcttcaacctgtgtcgggcgatctggaatatcttcatttttctcggttgttgtcacagtagttgtcggcaaatcaggaacatctacagtgggcggttcaggctcctgcggctgttccggggtttccggtgcggcaggcgtgcttggtgtatccggcttcggctctgtgggttcaacaggagttgtcggcgttaccgggtcaacgacaattggaggatctgttttttcgtcggggacaacatctggcttgccgggctcttccggtgcagggagatctccagtattacccttatcggtgctttcacccgaattttcgccgctattatcagaactgttgtttttgttggagtctgtgctaggagcggaaggaatttcttctcccgcatcaggatttggcttaggggtcgaaactccggtatcagcaccaggctgcgaattagaatcttctttggttgtgtcggtagaagattcagtatctcccttggtatttgaatcggcattgtccgaaatgtcggttccgggagtcgcattactgtctgtttggaggggattgctattactggaagcgctatcgctgtttgtcacagattcgataataccggcgacagtttcaggcacactcataccttcgtcgattgcaaacgaagtgacagcggttgcgttaactgcaacgagtgcggcaagcataatgcttaaggatttgcgaggtaccaatttaaacacacttctttcatgacttgactgctttcagcgtaatgattacattggctgcgttcagttttctggttgctcccgtagcagctacttttgctttgtagttgattggcagggtctccccctcccctattaccgggaaggctgttttactgatggtcagagctccggcgccggttgttgtgcaaccattcaaagacatcgcaatctttcctttatcattgtttggaaatgactcgtaattagctactttgtaagcaccgtcggttactcgaatatccgtgacttcaactttggtttttgtcgaattgttgcggatatccacgtttgttgcggtcaataccttaccgtccataacactgactggaaacgaagcaggaagtgtaacatcgatcgaattgattgagttaacaacggtaagggtgactggaattgttgtcgtttgctggcctgctggggcggcagcggcagctacgttagtagctgccagcatgcctgccatggcaagagtaagttttttgttaagcaacatttgcagtatcactccaatctaaaaaatcacggaaacgagaaatagggttcgtagatacatcgtagctggttacagcaccggaattgggatcgatgttcaaagaaagggtctttgtagaagctgccttgtaggtcaggtagccgcccgaagtcttggcgtaggtcttattgaaatattggctgttgtatgggatatcccccttcaagtttgtgcatttatagaacataaaatcaccgaagacgacaccatctgtattccaaccatcgcccgcataaatggttgtcaacgcgctgcattcccagaacatgtagctcatatccgtgacctttgccgtatcaaagccggagacatccaagctcgtcaggcgttcgcaatagtagaacatgtagcccatatccgtgacctttgccgtatcaaagccggagacatccaagctcgtcaggcgttcgcaatagtagaacatgtagcccatatccgtgacctttgccgtatcaaagccggagacatccaagctcgtcaggcgttcgcaatagaagaacattacatgcatattggtgacgttagttgtgtcgaagccggagagatccaagctcgtcagtttgctgcaatgggagaacattccatccatattggtgacgttagctgtgtcgaagccggaaagatccaagctcgtcagttcgaggcaccaggagaacattccatccatattggtgacattagctgtgttgaagccggagacgtccaagctcgtcagtaactcgagactggcgaacatgtcgtccatattggtgacgttagctgtgttgaagccggagagatccaagctcgccaagcttttgcaaacggagaacatgttagacatattggtgacgttggatgtgtcaagcaaagatagattttcaatagatgtaagtttctggaaccagcaattactgttagagcatgagaacatataagatgaatcagcattggctttaatctttcctgcaccgttgccagctataacgatttctgttcccgtacggtagcacttgatatcgcctgtattatttacatccgcattccacgtttcatcaacggtagttgatggcgtatagctatccataagcgtaattttcgtaatggtattgcgattctgttcgctcttataccagctgggcccagccgccagtgttgcaggttgttctctgtcggtcagatatccttcgtggatctttgcataagttttatcggtataaccactggtgtatgcaatatcacctttcagttttatgcagttgtaaaacatggattcgctgctcgtcagcgcatcgatgctccacttgttggatgcgtaaatggttgtcagactactgtcgtcgaagaacatgcgatacatagtggttacgttggatgtatcgaagttagaaagatcaaggatagttagcccactacaagaataaaacatctgtgccatattggtcacattggctgtatcaaagttagaaacatctatattcgacagtccgttacagccaaagaacatggagcccgttgaagtgactttagatgtattgaatgatgaaacatcgagatttgttagtcctccacaagagtaaaacatctgagacatatcaatagcatttgatgtgtcgaaatgtgaaacatcaagggttgtcaattttccgcaattagagaatataagactaaaatctgttacattagatgtattccaatcggagacatctgcgtttatcagactatcgcagtgccagaatagcgcacacatatttgttgttttgctggtattccatttagaaacatcaagaactgtaagagaactacagtcatggaacagttctttcatatttgttacattggcagtgttccattttgaaacatcaagagacgttaatccgctgcaatcagcaaacataaaactcatatctgttacattagatgtattccaaccagagacattgagggttgttaaggaattgcaaaaataaaacattcctcccatatcttttacactggacgtatcccagtttgaaacatctagatttttcaggttttcgcaacgccaaaacatttcgtacatattattgatgttggagacatcccagtgagaaacatccgaacttattagagaactacagttagagaacatatatcttgtattaactacattggacatattaaaattggagacattgagagatgccaaactctgacaattatagaacatcgctctcatttgagttacaccggttgtgtctaataaagaaatgttgtcaatagatgtgagtttgcgaaattcagaatcgtatgatgagaacgaaaacatatgtgaagaatcagcattggctttaatctttcctgcaccgttgccagcaataattatttctgttcctgtacgatagcaggtaatatctccattattgttctcatccgcaaaccaggtctcatctgcttcagtagatggcgtatagctatccatgaacgtgattttcgtaatcgtattgcgattttctgtagatttataccatgaagagcccgatgccatagtaggcgcagacggcaatccaactacgaatgtagctgtagcagcggtggatgatgattctgcagtaactactcccggagtctttgcatcataagaaagatttaaagtgccactggaagaaatacgatcaaaaccggaggtgtcaacagcgcccgatgcgtccatccaggaaccgttaaaccccatagaaatgaccttggcaccaatagatgccgatgcagcagcatctttcgttgccaacgaccaaccattttccgctgtgacgttgatggacgacacaaaaataggtgaactgccatagttgtgaatagctgcatttgtcgcagttgttacggccccgtctgaagataccgtaatcggcaaagatgccggtacggtcgcatcaatgtttacggcatatgcgctacatccaagaacgattacggatagaatggagataatcagtgattgagtaagtcgccgaaatattgttcgcatatcgaatcccccttacacagcccacttataggctacgtacaacatagaatcaatttcatagccactttgtccatcaacaggcgttattttcagatatgtctggtagtttccgtaagcaggcatatcttcgacaagcggaatttccgtagctgtttgacctggcttcagattttcgatacgaccaatcacctgcccagagtccttaaggacaagctctacggttacatcacaagaatttccggcggcattttgaatgttgcacggtacatgggaggcgccaacggttgcgaacaaatcggtatctgctttaattgttgcagtcgatccggtaaccgcatggttaagttcctcaatgacacgccactcgtcttctgtataccacttggcgtaataagtggtgccgacggtgaccttattagtaaagacaaaacgttgctcgccttttttatcaagataccagccgccaaacacataaccgtcctttttcggagtttcaatgggctgggcatatccgttttcgtcaatggtaacgctggatgcgctgctgccattacatgggtcgaagtagacaacatttcgcgggctatgcgatccgccgccgtgtgttgtatcactctgctttggatagagttggttgccgtccttatctacgactttgctttcattatctgccttgtcgcggattataatcttcggtagactgctcttatcacccagccagtgaatatagcagggaccgtctgtgcggctgataacgatttcgttgatcgtacagccgggatatacccaaacatcatgactgccccagcaaagcaaacggttaatgcttgtccccttcaggtccacgttgctgtcgcgcaagccgttggccagaatcaacgtatccttaaacgtgctgttttgaacagttgcgtcatgtataggccggagcagataaattccgtcactggaaacattactggtcgtaatctcactggagagtgcgttgaagcagttcatgagtagttgggccgtttctgcacgggtgatatattgcttggggcgtacggtgttatcggtgtaaccctgtaccctaccctgttccataagaacggctacggaagaacgcgcccaacttgaaatatcctgctcatccgtgaagtcattcagtttggaggtgtccgtggcgtccaatgccaatgctctggcgagaatggtcattgccatttcgcgggtcaagaggcccttcggcgatacggtccgatcagaagtaccggtgatcgtacccatctgaacacccatggccacattgtcaaagtaccagtcagtttgagagacgtcttcaaactgagagatgtccgtttggcgatatgtggcgaataaacggtctatcaaactgacgaactccgctcgggttatattgcgctctacggtcagtgtagtcttgctggtgccaatcatgatatcgttgtctacaacgaatttaaccgcaggcgcatgccatgcgttagcgttgtagtcggtataatcggcgacagatgccgcgcctgccataggaataagactgtttgccgcagttgctatggctactgcggttacaataattctgtttttacccattgtgctttccctttctttttgtgttatgcccatcccactgtgaaaatcacatttgccacctgtatttcactcagtgcagcagactgtgccggaatggcggcattatatgaaacgaggcatcgctgagcagcctcaatcgaagtttccaaattttcagataaagtatcggagtttgtgtcagaggcagtaattatggtttttccgccaatggtaagctccatacctattttctttgtgtcaacagggagtttttgaacttctgttttgtcgtagacggtcagaccccaatcgttaatactggtcatctcgactttgctaatggatacgggatacgaaccgttgttgattatcgctgcgtctgtggcggtagcaactgtgccgtcggccttcatgctgactggcaacgaagtaggcaccgtcacactaaatgcggccgctccgcgagtgacattaaccggagcgcttgcagatccagttgatgcgtcaactttggtatcagattctgctttttctttttcaggagtagctgcacccgcgcttatatttaaagctattgcagccaaagctagtgttccgcagattttttgtagggatttattcacttcaacctaccctttctcttgcattcgcaaagaaacgaaaatttctctcgctcccttgagaatacatgcgaaacaggttgtgaaataaggcaatactcaagacagcgtaactacaatattttgtaatgataggagccaatatgccgatttttaaaaataagaacaagaacacagaagcggaactccacctcggtgttcttgttcttatcagagtacccgcgattatatttatggcgcgtgtttaggagttccagcttacggtaacaacgatgttcgcaacggttgcgttggtgatcgtttgagataccgccgaagcatttgcattataaagaacagtcagctcgttagactgatcggttgcatccttgccgttgataatccactcagcagcagtgcctgcagcatcgtccagcagggtctgtgtatttgcatctgcattggtggttgcgagagcagtacctttgccaccctgtgcgccgccctgcggagtaatctgaacgccaatcttgttggcatcaactgcttccttggacatgtcagtatcatatgctgcgagcttccagtcaccgtccttgttcaccttgatattggataccttgatggaaccgtaagaattattggtgatggtagtgttatcagccggagttaccacgccggtggtcggatccatcgtgacggggaatgcagtcgggaccgtaacgtcaaataccgttgcatcagcagagatcttcactggaatagtgttttcagactttccggcgttcagaccagttgcagcaccacccgctgcaaaagaggtagctgtcatggccatcgccataaaggcgctcatagcagccgaggcaatttttttgttcaacatagtgtattccctccttattatgcctgggcagcatcccatgccaacgtgaagattacattagcagcagtttctgccacggaaatggcggtatcattggcggtggcaatcgcacctacagtaatcggcagcttggcattgtcagcgccgccgtccttgccctgcatcagccactgagacggagcgaaagactggttaccgtctgtattgctggcttcttcctctccctttgcggtcagagacaggccgagtttcttgctgccaactttttctgctgcgatctttgcacggctgccgccattatagtcggtcatggaccaagcgctgttgttcatcgcaacggatgttacttttactgggccagaggagttgttgataatctccacattcttaggcacagttacagtgccatctgccttgacggcaagaggaattccggtcggaactgtaacattgaacgtagatgcctccgcagttacagttaccggggtggtacctgcaccaggagccgaaacgtcatttgctgcaaaagcagacatgccgagtgccgaagcaatcagagcggaagacatgagtaacgatgccgttcttttcagtttcataatttcacattcctttcaaaaaatgaatttgtaatatatgtcgtcgggagaaagctatacgttcgactccaaaggcaccgaagagtgtcctgtacaacatctactcgaaacaaccaaattagttttcgacagtgatagtgatttccgcacctgccgtaccgaggatagcgccggtttcgggatcagcattgttgagataagcaacgcaatcgtaggtgccagccgggagatcaacgctcagggctgcattttcgactttgctgccaacagggataccgccagaacggtaaatctcttcgttcgtgtccttgcgaacgatataaacgatctgcggatagtgatttgcctcggaattgacaatcatcagattgcccttggacttgccatcatgaaatgtcggagaggtattcatcgaaatattgatcataccctcctcaaccttcttgttgagttcagcctggatctcttcttcgctccggccgttcaagccgccttcttcggcgttggtatcccataccatgccgttactgttgccgtcatcagaacggtttttcataaagcagtaggcagaaataccgccggccagtaccgcaatgattgcgataaccgcaatgatctttttcttattgcttttcttctgagtttcagacggctcagttgatggtgttttgttttcctgattatccatcagtattgatcctccaatcgacgtgagtatgcaaacaatcccaatattcctcctgaatgtgtggaattgcgacaggagaataaaatgtactgggtttgaacgagcgtacgtggctgcaaatggccgagttacgcataacaaaaatatcgctctgttttaagtatactactattaaaaattgtgtgcaataaatatttttgcaaagtgcaggaatatataatcgggtaataaataaaaaataatgcataataatcgtaaaatactgttttaatatcagataaagtttaatcaaatacaatcaaagaaaatcataagcatattataccatccaatgcaaaatggtaaataataaataaaagcgcctcccgaggaagcctcaggaggcgcttttatttattcttcgtcgtctagaatgtattcaaagtctcgatattttatggattgcatacagcataatccatacattgcggcaatgtacgatttgatagatgaagcaaccgacttgaaaggtagatcttgctctcggctgagagcatgtgcatacgccactaagatttccttcattacggagtcccaagtcttctcagcaggatgttctcctaccattcgctttgcgtcttccatagacatatttacccactgacaccagacatgaaggtcatcctggcactggtcaaaccaaatattcttacgacctttggtcgaaagaagacgttgaatattttcgttgaaagcaactaaccacttttcgataaagcaattttcatcttttgttgtggtgcgattgttttcaccggcagcctcgatcaggtaataagaaccatcatccgctcgattgacttgaatcgtaatcagtgatgtttttggggctgatttcttacgcataaagtaaatcaacatatcgcctttggcttttacgatatcctgacagtagcttcctacgcagtgatgcagctgaatgccttcatccagaatatcgtccatggacattggctgacataccatataggtatcatcttcaacgcaattccctctcttgccacgatagcatgggacaagccgcttaatagaggctgcctgccagctggagttgctgtgaacttttttatgagcattgctgatatcaaccatagcatcatgggccaactgaatattgtgtggaagagtaaacgcctgagatggattgatttcacgagccattctatgataatcgtatgccaatttcagcactttggccataatgaagtcagagcgtgcgtacttcttacttttcacggccagataacattctgacaagagccatttgtaaaaatcggccaaggaatatgttttatatatctcatgtaagacatacatctgctgcgcataagaaagattttcgacaggaaaacgcaacttgtcgttagccacaaagtacgggcaggagatctgtgtcacttgccaagcggacacgccactcccgttaaccatgagctctgcatctttatctgcaaacttactgtaaagtcgcttggcccgaacatatgaacagggtgagtgcaaattcatcagcttccagaatataaatatatctgatgtaggctcgctcagcatttctttgagtgtaggcttatcaacccctaacacttgctgcagattttttatttccccgaagtaagggagatagtaactaaagctatagagcaataggggcaagaaccagtcacacttttcgtgtgtttgatatatactctgtaaagcattgccaaaacatttttgcatttggagaagaatatctgcaccttgaactgataatcttccaccaacaacaacatattgcaaagctcgaacgatagtgttagctggaagatcaaataaatcattataccagttgattgggaatccggtgagatcttctgtgattttcccaatcgaggtgacctcagatacaatctttgaactgataatattatagtgcgaatccatcttcacatcacaagagagagcctcacatttgtataaagattgaagatatgtcgatagaacatcaacatattttttgtcattaaatactccggagacggcattatacaaaactcttctctcggcactcaatgtgctaacgattataatcttcgagaaatcatagagcgaatataccggacagcttttatccaacatgaatgttgacccatcttcagcaggcattattggacaggttgcatataaaacatcgccccattcattatttactgcgattggaatagtgcagtgtgtttgacaccccgtccagagaatgctataagcattggtcaatgaaagttcctcggatacgctgtctgggagttgaattacacatccttcggaagaaatggcagcggattttttgtttgaatacatggttctaaaacaagagcgggtgtggaaaacagcctccatcggcataaagccgaaatcttggcctggaaagtcagaggtagcaatgggaattacctttcctgtttccatatactgaacgcggcgctcccacatgtttcgatagaaccacttgtagatactgacgattacatcaaagagatctagagctgggtcagtatctttgtagtatttatgaaagtttgcgataacactcataatagtacgcggatagcattacgctctatccgcaatcctccttatacttatactgttaaatgatttgcacttcatctatccgggggcgccagatagatgaagtgcaatcaaaataattaaaatgttagtaagctaagataccagtccgcgaaagcatgtccccaaaagacggcgaacgcgaggccggtgcatagaaatggcccaaaggcgaattgtgtttctctttgcgcttgtttcgttatgagcaggtatgcgctgtatatgcttccagtgaggatgctgacaaacgctgcgactacaatttcttttgtgccgagtagtagaccgctcgccgccatcagtttaatatcaccaccaccgaagcctcctgaaaccaaaagagctatcagcagcataggaacacttacgatgactgcacctagaaggcgatttgtaatcgcagcttctgtggagtgaacggtcgatagaaccgctaacacaagaatgataacgtgtattcgatcgggtatctcgagcgtttcgatatcaatcaacgctgtgcagagtagcaccccgcaaaacgcaaatgcgagtatcgcttgtgcgctatcgccgaagcaaaacgccgaaaggcaagccgtaagtccgccgaatatggagggtaagagcgcctgcacgccgattttttcgaagcagcggcaacacatactgtgatacacaacagcgtagaaaaagttaaagacgcaggcgcctaagagaaaacgtattagccatggtccaatatagcagaaaagagacattttgttagcctttcacgaaataaaatctgtgtattttatggacttgcaacacagaccatacatcgcggcgatataaagactgccattgcatttgtgcgtcagttcataatcgtcgcaaacacctttcagagccgtatcccaatccgttaccttaagggctttctcaatggtactgttggctttatctaaactgtagctggtccattgacaccagacctgcatatcatctcggcacatcgcgtcgattgcttccttacgcttcataccggtaaatttgctgatatgggcattaaagccagcaatccatttatcaaggaatgccttttcctgccgtgtaggttcacgattgctgtctccggacgcctctacgatgaagtaattaccatccttatcgcggttcacctgaatggtgataagtgcttgatatgggaaagccttctcgcgcatgaagtagatcagcatatcgccctttgcatcaacgatatcctgataatagctgcctacgcagtggtgaagctgaatgccttcatccagaatatcgtccatggacattggctgctggacttcataggtatcatcttctacacagttaccacgctttccgcgatagcaagggacaagtcgcttgatcgatgcagcggtccgcgttggattcttgtgtgccttttcatacgcattgaagttttccgttatagcatcatgtgcagcgataacattatgcgagagtagataagaatctggatgcttcggggtgaattttatttctggcttgcgttttgccatcctttcttccatacggtaaatatcttcctggagaaaacaaattttctcaatcaaaagggtatctttggaatacttgccggatttggctgcgataaaacattctttccaaagccactgataataagcagagatggtgtatctcttatacaactccttatcaatgtaaaacagcagggatgcaaaaggaatctcgtccaaattcacggttaatgaatggttcattaacgaagctcggcgccataaatagctcgcacggagtgcatacttaccatctttatcgtttttaaggagttctgcatctttgatgcgaactcgctcataaagtcggcaggacgctgcatacgatgtgggagcacggaaattggccaaacaataaaatagaaaccgagacggatcctcttcagctaagatagccttcaatgtcggtttgtcgacatgaagaaattgctggatgtttctgggcttcggctccagaaacggaacacagtctctcaggctttttagaaccattggcagaaaccaaccgcatgtttcgtaggtttgcaaaatgctttgagtgagattgccaaagcatttgggtaaccatagtaaaacacttggagcacattccttgccccagcatttttcgattgttcccggcgatagatcatacgcatcatcatagaatgcatatggaaatgatgccagcgagttatcgttgttgtgggactgcttcaggaatgggtcccgctgccagacatcactaatgatgtcgtattttcggccaactgaccgaaagctgacatcccacgggatatattggggatgcttttgaaggactgatacgatgtagttaaacatcgaccaatcatatcgaacaccatcctggttgaacgagtcccttgcatcagagagctcatatgcattgccggtaaataattcgacaactctctttcgagagaatgcatagatgtccttgtcgagccggaaatgctgagggcagaaataaatgcgaggctgcatgtgcagatagcacattggaacatacgcataatatatagtgccccactctacattcacagcaaacggaagccatgcgtgccataaaaggccctcctgatacgatttctggaggcaaaatgaagaggtatacagaaaaggcgtatcttctttaggagactcttctgataccggcgcatcatctctatgtatcaatcgggttcgatctaatataagagaccgtgcaccaactatgctgtctcccgtcatttcaacgtctatggggcggaagccccattcctgtcccggaaaatccgagacagaaatgggggcttctgcaaaaggtttttctgtgtatgccatacctcgttcccacagtttgtggaagaaccagttgtatatgccatcaatggcgaatttgaaatcttttgtgatatctacattagcgtagtaacgccaataatccgagataatgctcattatttgtttttctcctttctgttgaggcagttatcacagaacagcgtggccagagcatcggctgcactgttgtgtgcattcccagcccattcatagccaaagtgctctgcacaggtagtcagtttgtgacgcggcttatcgctcaggcccttcgacttcatgtattcggcaaatgctggcatgacatcgcggacctccttatcgaagaagtcgatgtacaggcagttatgcagaaacgacagatcgaagggtgtgttgtaacctacgaccgtatgagcatgatcgacaatactgccgacactgatggcaacatcttcaatcgacggcgcgtgagcaaccatctcaggcgtaataccattgattttgctagccataggccattcagcatggacctccggtttaacataggagtcatacagtacgacaccagtgccactgacgatacttacctgcagcagttcgtccttgaagcaattcagacctgtggtctcggtatcaatgacgatagtgtgcaggcgggactccttttcgtggggcagatctttacagatcagatccgcgaagaagaaaacaccctcttcgatactgctgtagcagcacggcaggatatgatcccgcttgtaaatgtcttcggcaagcagtctcatgatcatgagaccaggaacaaccatatctaccttgaactcattatcgaagtcgtagagctcgtagaagtagttcaaacggtctgcaaactcaggagtatcgggatagccgatgaacatctgcagttcgtcatctgtgttgaagccgtagtggtctacttctacttcaaggtggaagaagtcgcgcagcttcttttttacggtgttgtagatgtcgtcccaattccacatagtaacagcagtagtcatagtaaaatgttcctttcttaaataacatgtggctgcggacatattgttcagcagccactatttttgattgtgttacggtttttgcggtatatgtgctgcatacatgtaagctgcatgcagtttcgccgccaacggatacttatcaaaggcagtggatatggtttcactgctgttttgagcagcggcatctaatcctcccatatgccatctgatagcaatagcttcctctggttttagacggacgaatcgttcaatcaaatagattgatttttcgccgccgcccaaagggaatttgtcttcaacaacgtaggtgggcacctgctcccatttacctttttcattgagttgggtgcgctgttcgagtttgaaataaccgcatctgcacagtttgtgcagcagagtgattaaaaccacgctgctaaatgggtcattgtcctgcgcaaacagcatcatgtacgccatgtagacgtttagagagtgttccagtagtccgcctttgtaagcgccgcgttggtttgcggttaacggagcggagaagaaatcacccttttccagccaagcgacaaggggctctatccccttgcgctcactggaaatttcgtttagcagggcaagaaatcttttctttcccttttcgatgtcaaaactcatttaagagtcctcccgcatcaatgagatttctgcatgtcccgcccgcaaacggagacaatgcgctgccatgcgggatcatatcccgtaatgtcatgtacagtgccatccgggttccaatgaatagtcatcggtaggccggcgtacgcatcgacgccatcgatatagatatcggtacgtgcagcgtcaacaaagcgccatgcataggattctgggcagtgggtgcagacgaaatcgtctacggctgcgccgagagccagctcggcctcacttttctcttcctcgttccaccagttcggattttccaaaaagacgataccgttgaagggtgtgaggacgcggattcggcggatgggaaaataagaccactctttgtatttgcgctttgcaaggtcgatgcgagcacgcagccataagacctgcttgcctcgacggcacagaagcataagttcatcgagtttatcatttttccatttccagtccaataccgtcagcccagagttgtagatgcaagactcaacctcctggttgtagcgcatgaagcgttccatagagatttcgctaatgcgctctggattggatatgctcgaataaaggacgaattcatccttgtgagaaaagaacgatctaatgtcgttcagggatccgtcacacaggatgtctgccaccttgagcataataaggacaaagggcaggatttctccagcctcgaagtccgggaaagctcgtttaacgagcatcggtacaacaaataccgaggaaacaccaaccaatgctttgatagcattccatacgatgcgcttgccgttgacagctaagcgctttttgttctttttcatgatattaagacccctttgttttttgtttgtgaaacggttgagttgaatagatgtgatatcacctccaaagatctgaaatgaccaagttggacatttcgaaaaaatgtatataaaaaaagacacctcgtagcacataagtgcattgagatgtcttttaaaaagcgtgtgaacagtcttcatcgaagaatagatacaactgcaataataattgcagacaagagagactaattacaataatattatatcgtgaggatgggagactgtcaagaaagaaaactcatagatgtcattgaaagttatttgtaaaagtaaattcctgttgggtatggaatttaaccttacaaacgcatctgtgatttacctatggaatttagtcttacaaatagctttcacaagtggaatagtctcaaaaataccatataagcaaacaaggtgcaaccgttaggctacaccttgtttcaattatcccttaagttggttgaataggttgatatttaggcaggtttgctctcatccagagccttgacttcatcgactgtcaggagccgaacggccttagcgatttcttcataggacaactttcccaatgtaagcaactcgcgagcggtctcaatcgagttgagtctagccgcttcacgcgctgcttcacgcgccgcttcatttctcatatcttccataaccttacacataatcgcaactcctttcgcgtcttctttgaaatagcgaactcgattcgccaaaattggatagatcatatcatcggccttggtgcaggaaaagtcatgcataagccgcccgagaaccgtatcgtctttgatctgggaattcacatatataatatgtgattcatccccaaacaatgtgccggtttctttgatcgcccgatcaatatgatagattggatgaccgccacctaacacatcattctcagtgatgaaaatgacataggtttcgttcagcttctcatattcatcaccaggttcggtcacgttggcgtcaattagactgctgttatatcgagcacgttcaacgccagcacctttatcgttgcgctgcacctcgatattgtaaacgtgattctcctcatcgacagccagaatatcaagccgtacagagcgtccttgtaaattcttaatatcgtgctgtccgtgtgcgtactgtacacgcaaatcgttgcgctgtaaaatgatctggagtaagaactcggcacaggctttgtcctcaaacaccttattcataaaatcatcatccagcagacgaaaaccgcgcaggcgctccaaatcttctgcgtgcttgcgctcaaaatctaaattggaagagctactcacgcaagcacccctctttcattcatctttttcattttgaaatcctcgctttcataaaaaattatataaaaacggggcagaccttgtggtttgtcccgaaattatatcagggacaaacccgaatcgctatacttccatctcttatcttattagtatgtttgcatataataaaatcatttacaaaatacagctctgcttacgcaggaaaagatacacgccacaaggatggcttagagagactttcttttattataatagcatatcccactcaaaaagtcaaaaagcattgaaactataaccgtaaaatgataatatagttttattaagcgaaatcccaaaaatttgtttgaaatactgcaaagttcggtggatctcgcaacaaaggagctgatgcaagtgtattgatgaatctgaaataggcgggcactcaagataggagtattcgcctatggcaaaacattcacatttaacattaagaatccgtaagattgctgaaatcgaaaatgcttcaaaattcagagtaggaaaccatgcggtttcgctctttttttcattcttcgccggaattctgttccggagcaccgttttcgccattcggcttgcggcggcgtcttccgcctctgcggcggcgacggcgcggcgcaccttcaccgtccggagacagctcattctgagcatcttcgggcagttcgtctcctgcagtctgctgcggggcaggcctgcgcggcggacgcggctgctgcggcttctgatgcggagtctcgctctttttcggtgcatcctttttgggtgcggaagcggcagcatcctcctgatcctcgcgcttacggcgttcctcggccatagcggcggcattctgacggttgcggcacgcaccctttaccatgcagcactgcgtgcactggaactcggtcagcgagtgctccggactgtcgtccagctgcaccttgcaggtgccgcgcagcatctgggtggaaatcaccttgccgcggccttccggcgtatcgaccacgctgccctgacgcggcgtgaccttctgcagctcggcgtaggcctcatgctcatacttgagacagcacatcagacggccgcacacaccggaaatcttcgccggattgagtgacaggttctgatcctttgccatattgatggagaccggatggaaatcatcgagatacgagctgcagcacagctcgcggccgcagcagcccagaccgccgatcatcttcgcctcatcgcgcacgccgatctggcgcagctcaatgcgggtacggaacacgctcgcaaggtccttaaccagctcgcggaagtccacgcggccgtctgcggtgaagtaaaacagcagcttgttcatatcaaaggtgcattccgcggtgacaaggttcatttccagaccgcggtcctcgatcttctgcttgcagataataaacgcctcgtcggcacgctttttgttgcgctcgagcgttttcatatcggtctcggttgccacacggaccacgcgcttgagcggctgcacgacctgctgatcgggcacatcggtgttgccctgcacgcagtcgccgtattccacgccgcgtgccgtctcgacgatcacacccgtaccgggtgcgatttccagaccctgcgggtcgaaataatacatttttccgttcgatttgaaacgaactccgattattgttgtcaaaaagttttcctcctgtatgatggaaacgcttaggaagcgtaacagatgcggtaaatatcgctcgttaatgcacaggtgacagccgcggatgccgcattgcgcgacacacggtcgatcagcacatcaataaaatcgtagaccgccaacagacgttccatactgacggcgccggcgagtgcctgcgtctgcttgcggagcgcaggctgcagcggcttttgcggcagagccttcgagacaaaaatcgcgtcccggacagcggcctgcagaatgccgagcacgcctgagagtgcgcggcgcggcgtcttttccagacccattgcactgagcatcatgcggtcctcgcgccgttcggcaaccgcagagagatagggtgcaagcagggttgccgcttcctcgtccgacaccgccgcctgcgacggctcgagcgcgaatttagtgcagcgcgagcgcacggtctgcagcagcgaatccggctgctcggcggtcagaatgaagaacgcatacgcaggcggctcctccagctccttgagcagcgcattctgcgccatgggattgagattctgcgcatggtgaatgactgtcacacggcgttcgccgtcgtttgggataatggcgttttctgccttgagctgacgcgccagatcgaccttgagttcggcctctccttcgtccacgatcatcagatccgggtgcacaccctgctccaccttgcggcacggcagacagtttccgcacggatgactgcccgcgccttcgcataaaataccggccgcgagtacagtcgcaagggttttgagcgctgccggatcgtcaccggacagcagcacggtctgcggaaaccgctcgttcagcgcatgcttcaggctgtttttgagcgcattgttgcccgcaagtgcgtcaaatgaaatcacagcttttcaaaacgctcgacgttgagtacaaatacggttgcgccgccgacttcgacctgcaccggcgtggacgggaaaaagcccatgccgagttcagcagttgccggcatgatctgcttgcgggaggaggagtgctcgcggatgatgtcaaagcactcatccagcttgctctcgtccagaccgatcaggatcgtgacgttgcctgctttgaggaaaccgccggtggtcgccagcttggtgatggagaagcctgctttcatcaggctggagataacatcctgcgaatcatcgtaattgatgatagccagtaccattttcataatagtaaccccctatacgcattgctgcgcggaaacatatcgtttgcttggatgagatgcgttattgatggacaacaacggttatttcatctattgtattgtaccatctttcacggataagtgcaatgtgcgctcctgtaattttctcgccgggccagagcagcggcacaccgggcggatacggcgtgaccggacgggcgcagaccagaccctcggcagcggcaggctggactctgccggtctgtgagaaccatgcgtcgcgcacgctcatcacgcgctcggcgggcggaaacggtgcggacagggacggcaggggaatcagctcgcgccgtctggaaatgcgccgcagaccgcgtttcagacggctgatcgcaccgttcgggtcggagccggtgaggatgaacacaacattgcggtcgtccgccatttcgcacgccacgccgcattcgctccacagcgtatcggccagctggtgaccggtgatgtcggttccggcggtgcacaccgtcagacggcatgggtcaagcgcaggaaaatgatcctcggtcagtgcggtaaacatggttcggtgctgcacataggcacgcagttcggcacaggtttccgccgagcggcggtactctgcgtgaccgggcccctcggtgtaggcacgcgcaaggtcaatggatgccataatgggataggacggactggatgtgccgaacagcatggtgttttcgcgcagtgcgcggcggtccacgcctgccgcggagagcagaacggcgccctgtcccatgcacggcagcgttttgtgcatggagagcacggccatatccgcaccttccgcgaccggcgtcggcaggccgacggcagggaagtgtgcaccgtgtgcaccgtctacgagcagcagcttgccgtgcgcgcggcacagatcggcaaactcgggaatcgcccgccggatgccgtaataggtcggtgaggtcagaaggattgccttgatctccggatgcgcgatcagctgtgcttccgcatccttgaccggaagcgcaccggaaaccgcgaatggctcgatcagcggtgcagaaaagaaatacggcgtaatgccgagcagcgcgcagccgtagcagacggacttgtgtacctcacggtcgagcaggacagcgccgccgcgtccgaccgctgtgccgagcatggcgagaatgccctgtgtcgagccgccggtcagaaaaaagcagtcctccgagccgaaataccgcgcggcggcaacctccgcatcgcggataggaccttcgccggtgtacaggttgccggtgccgtaggtttcggtaaagtcgatagcaaaaatatccgcatatgtgttgaaaaccggctcacccttgtgcccgggcatgtgaaaccgcgcggagtcaccggtctcgagcagctgcagagcatggaacagcggcgccgtcgtgaacggcatcaggcggttgatctgtctgtgattgggacggtggctgtgcggcacagccggtcggcggtggtgcataatacagttgactccttactattataactgactatcagtatagcagaaggagagtaggttggcaaattgagaataacgcagtataggcaacaccgcacaattaaagcggcggtgctttgcggaaattttgtgtcctgactttgttgcagtttcacggtaatacatcaagtattaccgcaaaactgtgcctcgtcagtacgcaaaatttactcgcaaatcactcttgttcaattatgcggtattgcctataatattttctaaaagtgttagtgcagggcggggggggcaccccgccctgcagtagtccggataaacagtcataagagagaacatgggtgcagtccatattcgcagccgtacatttacctatcataaaaaattactgatttttgattacgcattactaattttcatggactgtccacaatgtgcagacaatcaatcattcattgcggattttttgggacatttttcggtagcaaacggcagagctttgtattataataaataatacgttccattcataaaagtaatatcaccgcgacagactgtgatatgtaaaccgggaacgtctttacgcttatatttgaaaggcaggctattcactatggcagacaatcgtatctacaatttttccgcaggcccctccatgcttccggttccggtgcttgagcgctgtgcagccgacatgctgaactatcagggctccggtatgtcagtcatggagatgagtcaccgttcaaaggtatatgacggcatcatcaaggagaccgaggctacgctgcgccgcgtactctccattccggataactacaaggttctgttcctgcagggcggtgctaccacccagtttgcagcgatcccgatgaacctgctgaagaccggcaaggctgactacgcgctgaccggcagcttcgcttccaaggcctacaaggaagcacagaagttcggagacatgcacgctgcattctcctccaaggagaccaacttcgaccacgttccgacgcaggatgagctggatatccgtccggatgccgactacttctacatctgcgccaacaacaccatctacggcaccgagtatcagtacgatcccgagaccccggcaggcgttgagctggtagcggatatgtcctccaacatcctgtccaagccggttgatgtttccaagtatggcgtcatctacgccggcgcacagaagaacatgggcccggccggtgttaccgttgtcatcgtccgcgaggatctgctcggcaactatccgctcgagaagtacccggttatgctggactggaagaccatggctgacaaggattccatgtacaacacgcctcccacgtacggcatctatgtactcggtctggttgccaagtgggttgaagacatgggcggcgtaaaggctatgcaggagcgtgctgaaaagcgttcctccatgctgtacgattacctcgattctcaggacttctacaagactgtagccgcaaaggattcccgcagccacatgaacgtaaccttccgcaccggcaacgacgagctggacgcaaagtttgccaaggagtccatggcagccggcatgtccaacctgaagggccaccgttcggtaggcggcatgcgtgcttccatctataacgcaatgccgatcgagggcgttgagaagctcatcgacttcatgaagaaattcgctgaagaaaacaagtaacaataattgagaattgataatggagaatgggaaattgcggtatcgcgcaaggatagcgacattttccattttcaattctccattttctattggaggataatcccatgtataacgtaaaactctacaacaagatctcgaaggtaggtctggacgatctcgatccggcaaagtacacctgcgccgaggatttcaccgattacgatgccgttctggtgcgttctgccaagctgcatgatgtcgagttcccgaagaacctgcgctgcatcgcgcgtgcaggcgccggtgtcaacaacattccgatcgaccgctgctccgaggaaggcatcgtagtcttcaacacgccgggtgcaaacgctaacgccgttaaggagctggttgtctgtgcactgctgctggcctcccgcaaggtggtacagggcgcaaactgggttaagggcctcaagggcacgccggatatcggtcctgctgcagagaagggcaagtccacctacgcaggcccggaaatcgccggcaagaagctgggcatcatcggtctgggtgcgatcggcgttaaggttgcaaatgcggctgttggcctggatatggaggtctggggctatgacccgtacctgtcggttgacggcgcactcaagctcgaccgctcggtcaagcacgttaccgagctggacgagattttcgcaaactgcgattatatcaccatccacgttccgctgaccccggataccaagcacaccatcagcgaggaagccatcggcaagatgaaggacggcgttcgcgtcatcaacctcgcgcgcggcgagctggttgacaccaaggcaatggcgaaggcactcgagagcggcaaggttgcagcatacgtttccgactttgcttccgacgagattcttgagcaggagaatgccatcacgctgccgcacctcggcgcttccaccccggagagcgaggacaactgcgctaagatggccgtttacgagatcaccgagtatctcgagaagggcaccatccgcaactctgtcaacttcccgaacctcaaggttccgtacgaaggcggctaccgcatctgcatgatccacaagaacatcccgaacatgatcgcgtccatcacctccgctgttcgctgcaacatcgagaatatgggcaaccgttccaagggtgactatgcgtacaccatcatcgataccgcagaggctccgaccgaggcgaacctcgacgagctgcgcgcgatcgaaggtatgatctctgtccgcacgatctgattgccataaaactgataaaaccgctctgaatgcagattcggagcggttttttgttgcttttctgtgcaaattgaatattgtcgaatttggtcgaattttcgtagaatatggaaatgcaggataagacagcaccgcagctctcagtgtgcggtgctgccgaatgctgcaggatgactatttttacaggaggcttctcaatggagaacatacgcatttacgaggaggacggctatattcactttatcatgcgtccggaggacctgatgcggctgcgctactcgaccgaagcgaaaacgccgtttgcagacttcatggaccgctggctgacccagatgaaaacgcaggtgcgcgaaaacacgatggacggctaccgctacgcatttgaaaagcacatcaagccgtttttcaccgcacgaggaacaacgcttgctacggcacggccgatggattttcaggattttgtcaacctgaaattcgatcaggggctttcaccgacttcgatcgtcaagttccattccatcatgcacaagtgcctgaaatacgcggtagcactgcagattatcccgacgaatccgtcggataatgtcatgctgcccaagcggacgcgctttcgaggacaggtgtacgaccggacgcagatcaacatttttctggcagcggcgctgcagtcgccggcagaggcggcgtttgtgctggcggcaacctatggtctgcgccgcagcgagtgcgccggtctgcgctggtgtgccgtggattttcgggcacggagcatggtcatcaatcatacggcggtgctgtcctccgggcgtgtgatctacgcggacagcgtaaagaccaaatccagctatcggacgctgccgctgtccgactcgctccggcggtatctgaccgatctgcgccgcagacagaacgccaaccgcaaaaagtacggcaaagcctactgccagagcgattacgtctgctgccgtgaggacggttcgccgctccggccggattacatttcgcgtgagttcgagcgggtgtgccgccgcgcgtgcctgccgcgtatccggtttcatgatttacggcattcggttgcaacaattttgctgcagcagggcttttcgctcaagcagattcaggactggctggggcattccgacatctcgaccacagccaacgtttacgcacatgtgccgtatgtggaaaaggtatccatcgccaagagcgcaacaccgattatcggaaactgatgtgcattctgggaatgtaacataatcgtaacattccggcgggttgtttcaccattgttacactttgccgcctgaccttgtatgagcgtgcgtgattgcttataatgtatattgtataagaataacaaggatagagaactttacacaatatacaggtgaagcatatgttcaaaaaaacactttccgcgctggcggttgcgtgtgtgatgctggtgagcgcggcggcggccggcaccatttttccggcagagtacaccgacattgacggcgtgacacgcgcaggctatctggatgaggacggcatgaccgtacttccgtttgcctacgcacaggcaggcgatttcgcggactgcggactcgctgccgtagaaaacgagcagtggcagacggcggtgatcgaccgcacgggcaagctcgtcattgcatacacggattcgccggtttcggtggatttttcggatacgatggttgcgtatcgttacactgaccacagcgtgtattatgcgactgacggcaagcgcattggctcatatccgggcgcggtcggcttctttgaggacggattgctgctgtgcagaaatgcggataccgggctgtattcctatgtcaagcaggatggttcgactgccttttcgggcagctaccgtaaggccggtgccttctcaaacggcagaacgcttgtgcagacgcaggacggcgattatcaggcaatcgacaccgagggcacggtgctgtacactctgccgaatgacgtaacgccttcctacatggcgatttacggcgagagcacggtggtcgtcaccaacggcaccaatcaggcactgtattcgctctcggagggcaaactgctgaccgagtttctgtacaacaccatttcggagtttcacgacggcgaagccatggttcgtcagatcaaccgctggggtattatggataccaccggcaagctgctgacggcgccgacgtattactatctgtcctacatgggcgagggtctgtacgcggcccgcagcgaggacggctcggtttccgcggtggatgcgggcggcagcctgtcttaccgcacactgagctacatcagcggcttctccgagctgcgctacggtctgtcgtggcacaacaccgcagacggcacactgattttcttccgcaaaaacggcggctttgcagcatccgttaaagaggcggagaacccgaccattctgactgaaaacgtggtctgcgtcacgcaggatgacacccgcaagtatattgatctgcgcagcggcaaaacgctgttcgagcagccgaagtcgttcgaccttggcggcggcatcactgcaaagaccgtgcattacgaaaagttcatgggctatcagcaggacggcacggagcatggatgggatgtcgattttccggagatcagcggcctgagcgacaaaaaggtgcagaacaccatcaacagcgaaatccgctcgttcttcctcaagggaccgtccgttaccgccgagtatgatgcgctcgagggcagctacggtgcgtctgtggaaggctcggtgctcgttgtctgggccaactgcgtgagcggcaaaggcgccggttcgtcggtctggaataactgtctggcgtttgatctgcacaccggcacgcagtacacactgaacgacctgctgaccggtgactacatcgagacggtcaagaagctgctgccggacgatcatgcgatttatctgtacagctatccgcgcatcagcacgaaaggcgtaacctatttttacaacgaatacgagagcgcttcccgccgagcttatacagaggaatatctgctgacgtttgagcagctttccgatgtactgaaccggaacagcgcgtgctataaggcgttgatgacgtcgtattcgcccaaagtttcggctgctgcgaccggctacagcgatgtaagcagtacctgctgggcactgcagtatatcaatacagtgaccgaacgcaagctgatgaccggcgcgaacggtaaattccgtccgaacgataagatcacggcggccgaagtctgcacgaccatcgcgcgtcagcgcggtctgtctggcagcggcgcactgcccgcaggcgttcgcgcaggcgagtggtactcggatgcggtcagcgcggtgtatgcaaacggtctgctcgagggcctgagcgataacttccggccgacggctgccatgactcgcgaggatgcgatgcagctttttgcaaatctgctgcaggcggacggcactgcggccatgagtgatgccgaaaccgcacagacgctggcgtctgtcaaggacgcaggctctatctcggcggaccgccgaaatgcggttgcactgtgtatgcagaagggtttggtgcagggcttcagcgacggcacgatcaagccgcagggtacgttcacccgtgcggagttcgcaaagctgctgacgacgatctgaagataagagaaagaccgatgaaccttggttcatcggtctttttactttacggtgcattttgtcgaatcttgtcgaataaacggcggtatggtataataaacttgttgctttaccgagtcccggcaacgggaaggaggtgcagcctgtggataacaatacgttatcgtttatctactcaatcttggcaagtgtagtcgcacactacatctgcaagtggttcgatgagtggaggtaaagtgactcccagaaccccggtttaagccgccgtataatggaatagaaaaccccggaggatgcaccctccggggttttccacgcctatggataatgtgttatcgtttaaatatagtataacaccgatcttgcgataatgcaagcactccgccgattattttaccggaatcgtagtatcaccgatggtgacggacgccacttcatcaagcgggagaatggtatcgaacgtgccctggcgggtgcagacggtcttgccgtcatgcgggtccatgctgctgccgttgcctggcacgtcgattacagtgccgtccttcttattgataagcagttttgcggaaaatgcgtcccatgtatcgcggtggctggcgggttcctgaccgctttcggcattctcaaacggtgctttgccatcaaccgtgtagacaaagttatagccgataggcgagagcaggactttattgatcgttgcggttttgccacctacttgaatagactgaccggcaggcagttcaaccgcgctgttatcggcctccagcttgaacttgagatgccaggtaccgtcggcgatggttttggtttcagcgccgttatcagttactgctgtcaggtcgccgagcataatctttgctgtaccaccggtcgtaactgcgtcagtgtacgacatggtttcaacatactgaatggcattatcattcggattttcgtcatagaaatagctactgccgattgcgccttgcgcattcaggccgatattgctgtctgcacgattccagtacacattcagcagaccggtatccgggtttttcgtgcagtcgaacgccgaaccgtcctccttttcgagcgtgtaggagataaggtagttgtagccatcaaacagaatcgcatccgcggtgacggtcacgccgcccgccgtatcgctcgcgccgattgggcggccgatctggtcgatgatttcggtgtctgctgttggaccgaatacgccggcaaatgcgtcgctcgcggacttgaatacgccggttgcacccgcaccgatgctcagcaccagagcggcagccacgccgaccgccgcgatgcgcggaaaacggcgtacacgatgaatggcaaccggctgctccggctgctcggcggcggccatcaggcgatcgaccatgcggcttttcgcttcttcggagaagcgcagctcgtccagtgcagaattatacattttgttatcgttatactctctgttcataaagatcccctcccaaggtggtgcgcaggcttttgcgcccgcggctcaggtgtgcggaaacggcagactcgctctgaccgagcagagacgcgatttcgcgcacggaatagccctcgtagtagtgcagatagactgcttcacggtatttgcgcggcagcgccatcaccgcatcgagcacatcggaatccggtgcggcaggcgcgggtgtcgcggcagcggcttccagaccgacattgcgccggtgcgcggcgcgcaggctgtccttgcaggcgttggcggtcgcgcggatgatccacgctttttcgtgcgccggactgtcaaaggtttgaccgccggtcagcagcttgagaaagatattctggcagatgtcctcagcatcgtgggttgacttcaaataggtgtaagccagccgcaggatcaggtcggagtacgtctgcaccagacgttcggcgtctgccctgtcaaattgtttcattggtttcagctcctttggaaagcaacgttgcttcacctataatacgattgcggatcgcgtatcctgacagagaggataaatttattataacataaatgcgttggcgggcaccgttcccgcgcgccgcagagcgtacctctcgcttttcgtcaagcgtaaaaccttcgattttgcaagagatagaaagacacctgtccgtctgcgcgttgtttttcaacagaatgcccaaaaaacacaggtaaaattgtaacaaagtaattgttaaaaaatctacaaataccctttgcagaaagccctgtttatggtatcctgttataagaactcgtgcgctctgccgggagcgctcacaagatagtatgacagggacgacccgattttccgggttgatatggattaggaggataaaacaagctatgactatgagaggtgtagaaacccgtattcaggagatccgccaccgcattttcaccgaggttgcccgtatggcgtaccatactgagtggccgaccgaccgccgcatcgaagcactgccgttcgacatcatgccgggcgaagtgggcaacatccgcaacgatattttcctcgagcgcgctatcgtaggcgaacgcctgcgtctggcgatgggtctgccgtgccgcagtgctgccgagcatgcgccgctttcggataacatcgaggctgccacccgcgaggaaacctactacacgccgccgctgatcaacgtcatcaagttcgcgtgccatgcctgcaaggagaacgaggtcatggtcacggacggctgtcagggctgcatggcgcatccgtgcgttgaggtatgtcccaagggcgcagtatcgctcgaccgcttcaacggccgttctgttatcgatcaggagaagtgcatcaagtgcggccgctgcatggatgtctgtcagtatcacgccatcatccgtcaggagcgcccgtgcgcggcagcctgcggcatggatgccatccacagcgactgcaatggcagagccgatattgattacgagaagtgcgtttcctgcggccagtgccttgtaaactgcccgttcggtgctatcgcagacaagtcgcagatcttccagatgatccgcgccattcaggcgggcgagcgtgtctacgccgctgtcgcaccggcgtttgtcggccagttcggcccgaagatgacaccgggcaagctgcgtgccgcgatgaagcgcctcggctttgccgatattatcgaggttgccatcggcgcggacctgtgcgccgcacaggaggccgaggactttgtagaggaagtaccggagaagctgccgttcatggcgacttcctgctgtccggcgtggtcgatgatggcaaagaagctgttcccggaacaggccaactgcatctcgatggcgctcaccccgatgacgctgaccgctcgactggtcaagcaccatcagccgggtgcaaaggttgcgtttatcggcccgtgcgcggcaaagaagctcgaagcaatgcgttcggacgtacgaagcgaggtcgatttcgtgctgacgttcgaggagatggcaggcattttcgaggcccgtcatatcgatgtggaaaacctcaaggaggacccgcacggcatcaacgatgcatccacggacggccgtaactttgcggtttccggcggcgtagccaaggccgttgtcaacgtcatcaacgagaaacacccggaccgcgagatcaaggtcgccaacgccgagggtctgcgcgactgccgcaagctgctgatggccgccaaggccggcaagtacaacggctatctgctcgagggcatggcgtgcccaggcggctgtgtagccggtgcgggcacgatgcagtccatcaagaaatccgctgcggtagtcggcatgtatgccaagcaggcggagcaccagactgcaaccggcacgcatcatgttgccgagctggataagctggttgattaaaaaataatgctataaaagccaccgtatcggatgatacggtggcttttctgctgtattggtgcggaatggagaatggtaaaccatgtggcccattctccattttccattttcaatcctcaattatttttcaggcggcgtaattgccaccttcatgaccccgtcgcggcgcttctcaaacagatcgtacgccgcttcgatatcattcagcgggaaaatatgcgtgatgagcggtgtggtatccagctgaccgcactcgatcagccgcaggatttctgcggtgtcgcagccatccacgccgccggtcttgaacgtgaggttcttgccgtacatatcgggcagcggaagcgtctgcggcttgtcgtacagtgcaacaacggtgacaacggcgttcggtcgggcgcactcccacgcgagacggaagctgtcgtccgagcctgccacctcgcagaccacatccgcgccgccgtgcgggctgttgagctgcacgaactcctgcgcgtgctcgggcgtgatggtcagcacatccggatagtgctcgcgcacaaagcgcagccgcgccggatcggggtcacagatgatgatcctgtgcgggtgatgcagcatggcgcacagcatggtgcagatgccggtgggtccggcaccgaggataagcacggtgtcgccctgcctgatctcggaaatcctggctgcccagtagccggtggcgagtacatcgccggcaaacagcgcctgtcggtcggaaacccggtcgggaatgacagtcagaccctgatcggcatacggtacgcggacgtactccgcctgaccgccgtcaatccggcagccgagtgcccagccgccgttgggatcggtgcagttgttgacaaagccgtgctgacagaaaaagcagtgtccgcagaacgtctccacgttgacggctacacggtcgccgggcttgacggttttgactgccgaaccgacctgctcgaccacgccgaccatctcatggccgaccgtaataccgggtacggcacgcggcaccgagccgtgcttgatgtgcagatcgctcgtgcagatgctcgacatggtaacgcgcaccaccgcgtctcctgcatgcgtgagaacgggttccggcttgttctgcagggcaaactcaccctgttttcgataagtgtaagcgagcatagtttacggctccgtttcgttaaatgttatatccattatacgggagggcgaaaagaaagtcaaactgtgtcgattttataaggtgccgagagtcgggaaaaactgcgccagaaagaaaaacagcaccggcaggaagatcgcaggcagcagattgccgacgcgcagcttgctgttgaagatgagattcaagctaatggcaaaaatcagcacggagccgacacacgacatttgaccaatcaggacatcggtcagccagggacggatgaatcgtgccatcaatgtaatgccgccttgatagaagaaaatcggcacaatagacaggtatacacccttgccgagagatgcggcgaagagaatcgaggcaacaccatccagaattgccttggcaatcagcatggttgggtcaccgctcagaccatcatttaatgcaccgacaattgacattgcaccgacacaaaatagaagagatgcggtaacgaagccttcaacaaatcggctgtcccctttggcagcaaagtgtgattgacagaatgcaccgaaatcttccagtcgctgctcgatattcagcgcttcaccgatgacagcgccgagtgccagacagagtataagcagcatggtatgctgggtgccgatttcgccatcctgtatggtcaatacttcgctgagtgttccgcctataccgataaagcaggtgcttagtcccagtccctgcatgaccgttttttcaaagcgtttcggcagaccgttttttaacagtataccgatagtagtgcctataagcaccgtgccaacatttacaatggttccaagaccaatcataaaatcccctcatttcactttacaacgctaaagtttattgtaaagcaaaatgaggggattgtcaattcagcgcagacaaaacggcgttttgcagaaatgtccgccgccgattctccgttcgggatcgggaagtgcaagcgcaaacagatcatccgcgaaggtatcgcggcagagcgccgtttgcagattttcgggcaggcgtttttccgtcaccggcttgacgataacgggcagggaggcggttttcagcacagagcgcccgcgcacgccgagcgccagtacgcgcagataagccggggagacaggtgcgtccgtctccacaccgagcacagaccgcaggagcgcacggcgcacacgagccgccggaaaccgccgcgttcgagccttttctacagcatctgagaacgaatgtgccgtatagaccgccttgcacagccgctcgtcaaagccgtctgccgagccggtccgcagtctgccctgatagagtgccgtccgcagcagcgcgagcagtgtgtcctccggcagagcgaccggcgcttcaccgcggctgacggcctcgttccacaccgcgcggcacggcggcggcaggaacggcgcacagaacgcgaaatcgccgtctcgcaaatgcgctctcagcagacttgctgaggcaaagccgctgtgcggcgcacgcgcatcgtgggccgcgccctgccggagcaccgcaagcgggcgcatcccgagcgggagcaggaagcggcagtattccacggcgagcgtgttgttcgggttatccaaaagaacggcagcctgtttgttgactttgctgagttcttcctgccgtctggcggcgtaggacaggtgcggagagccggattctcccttcatcggcaggctgttcaggagttctgccgcctgtaaaagcaaatccgtatccgcagtctccgcgccgaacgataccgtgccgcacccgagtgcgtgcagcgtctgcactgcacccttggcgaagccctccgccgaggacagcgccgccgcaagcggcagttcaaccacgaggtcagcgccgcagcgcacggccatttcggcacgcgcgtacttatccagcacggcaaaatcgccgcgctggacgaaattgccgctcatcacgcatacgatcacggcgttttcgccgaggctgcgccgggtttcggcaatgtggtgcagatgccccgtgtgaaacggattatactcggcggtgatgccgcatacggtcatgacggtgctcctttcagtgagatgacagcggtctgcaaggtaaaaacctcgaaaaaggggttgtacatttgcaaagaatcgtgtagaataaaaatatagcattattatataggcttccgcggctttatgcaagccgccaaatacggcataagggagttttcgcaaatgaaagtattggtaatcaacgctggcagttcttcgctgaagtaccagctgctcgacaccgagtcgggcgaggtaatggcgaagggcctgtgcgagcgcatcggcatcgacggtgtgctgacccacaccggcaacaagtccgatgagaagttcaagtttgacatcgcaatgcccacccacaaggaagcgatccagtctgttatcaacattctgctcgatccggaaaagggtgtcatctcctctatgagcgagatcgacgcagtaggtcaccgcgttgtacacggcggcgagttcttctcggacagcgttatcatcaccgagaaggtcatcaaggctatcgaggactgcgtaccgctggcaccgcttcacaatccgcctaacctgaccggcatcgaggcttgccgcgaggttatgggcccggacgttccgatggtcgcagtattcgataccgcattccatcagaccatgccgcagtcccactatatgtacgcagtaccgtatgagtactacgagaagtacaagatccgtcgttacggcttccacggcaccagccacaagtacgtttctcagcaggctgctgagatgcttggccgtccgctcgaggagctgcgcctgatcacctgccacctcggcaatggttcttctatctgcgcaatcaatggcggcaagagcttcgatacctccatgggcttcactccgctggacggtctgccgatgggcacccgtgccggcaacatcgacccggctatcatcgagttcctggctgagcacgagcacatggacgcacacgaggtcatcaatatcctgaacaagaagtccggtatgctgggtatctccggcgtatcctccgacttccgcgatctggatgctgcagttgctgacggcaacgcgcgtgcagcgctggctaaggatatgttcaacctgtccgttaagaagatcatcggttcctacgttgccgagatgggcggcgtagacgctatcatcttcaccgcaggcgtaggcgagaacgaccgttcggttcgctgggatgtctgcgagcacctcgagtacctcggcatcaagatcgacccggagaagaacaagtaccgcggcaagcagatggatatttccatcgactgggcacgcgttcgcgttctggtcattccgaccaacgaggagcttatgatcgccaaggataccgagcgtctggtaaacgatgccaaggctcagtaagcctttcgtcaattagacaaatatgggggcggagcataggctccgcctctgtttttgcccggagaggaaacttttatggagcaaattgatatcccgcaggagcgccgctactgctcgaagctgggattttccgtgctggcgatcatgctgtggtcgattctctggcagttcggcctgtactggctggacggctggatcctgccgttccgcatgccggaaacgctgtattacctgctgctgctcgtcggacattatgcggtctcgctgccgattgtgttctgtatatggcgcaaaacaccgccgatgccgttctgcagggagcgggcaggcgcaaagcgcatgggccggtggtttgtcatcggctgtgcgctgatgtggctcggttcgctcatcggcacgaatatcaacgacatggtctacgctctgaccggacgtgatccggtcggcatggtggacgagagcttttcgcagatgccgatggcggccatcgttctcggtgcctgcatcatcggtccgctgtgtgaggagctggtgttccgcggtctgctggccggccgtcttgcgcggtacgggcagaagccgggcgccttcatttctgcactgctgttcggcctgtatcacgccaatctggagcagtttttctatgcctttgcgctcggtctgctgctgtcctacgcgtactaccgaaccggactgctgcgcacctcggtgctgctgcacatgctgttcaacatcatcggctcggtggtgcccatgctgctgccggataccatagccgcgcagtcggcgctcggcctgttctggatggcgatgctggtgatcggcatgatcctgctcgttcgcggcagaaaacagcaggtctggctgcacggaccctgtgcgccgtcgcttcaagccgttttgcagaatgcaggcatgtttctgctgatcgtcgcctgctttgtacagaccgtgttcaattatctataaggaggaacgtccatgcgggtagacctgcatatgcacaccgaatattcggctgacgcccagtatccgcagtccatcgacgataaaattcacgcctgtgagcaggccagactggatatcatcggcattaccgatcatctggattttctgcgttcgggcggcacgcgcgacaaccgtgacccggaagcctgtgcgcgcgaggtatgggaaaagcgccgtccggcagggaacggcggtattgaggttctggcgggtatggagatcggccagctgcacgccacaccggatgcggacgattttgtccgcacgcatccgttcgatatggtcatcgggtcgctgcatgccatgccgaacgacctcgatatctactttcacgactttcccaatatggactgcgacaagttcctgcacgagtatttcgatcagctgctgctgctcgaggagcacggcggctttgatgtgctggcgcacattgattatccgctgcgcgtgatgaagcacggcgactatatcccgtcgtttgacaattatatggatcgcgtccagcaggtgctgcgctcgtgcatcgaccacggctatgcgcttgagctgaatgctgccggcattgcgggctggcagaaaaaggtcggtccaccgcaggatattctgtacgaatacaagcgcatgggcggtgagcgcatctcgatcggctcggattcgcacacgctggacaccgtggcgcgcggcgtagacgactgcgtgaagaatgcactcgacgcaggctttacccacgttaccgtgttccgtgagcgcaaaccggtgcagatcgcactgaaataaatgtagaggctgaaacaacatgctttttagacgaaaacaggaaattacacacgcggatacgactgttcgtgcccgtgcaaagatcaacttgacgctcgacgtcaccggacggcgggaggacggctaccacacggtggagatggtcatgcagtcgatcgcgctgcacgataccgtgcgcgttaccaccatccacggcgagaaaaagccgcgcggcatcgtgctgagctgcagcctgccgtttctgccgaccgacgagcgcaatctggcgtaccgtgcggcggagctgttctacaaggagaccggcgcactgctcgaaacctgcgagattcacatcgaaaagcgcattccggttgcggcaggtctggcgggcggctcgacggatgcggcggctgtgctgcgtgcgctcaacgcattgcatacagccggtctgaccgacgacgagctgtgcgagatgggacttaaactgggtgccgatgtgccgttctgcctgcgcggcggcaccatgctggcgcagggcatcggcgaggagctgagtctgctgcccgatatgccgcactgctgggtcatactgtgcaagccgccgtttgcggtgccgaccaaggaggtctatcaggagatcgacagtgtggatatcctcgagcatccggacaacaagggtatgatggccgcgctcaatcagggagattacgagggcgtgtgcgcgtacctgtccaacgtgatggagaccgttacggcggcaaaacgccgccagatcggcgaaatcaagtcgtttctcgcagaaaacggtgcggacggtacgctgatgagcggctccggaccgaccgtgtacggcctgttctcggatgagagccgcgccaaaacggcagcgaaaatgctgcgtcgccgtttcgcagatacattcctgacggaaacctgcaattaaacgggtatagaaagccgcctttcgggcatactgggtacaccggatgcagaaaggcggttttgttatgcagaaacaggatagaaaggctctcacggcagtgctgacagcggttcttgtgctgttctggtcagcgtttgcgccgcagagtcctcgtgcggcatggtggtgtacggcgttttccatcacctgcgaggaggcggcaggtgagagcagaacaggcagcgaccgggtggaatttcggtcacttctggcagacttgctgcttcacaaagataacacttaacttttcagtcgctctatggtataatgacacagtgaaacacgaaattcatttgccaacggaggaaatttatgaagatcattaacgaaaagggcaagctgttcggcatcatcaatgttgtcgatctgctggtgctggtcgctgcgatcgctgtcgtagccggtgtcggctacaagctgtttgctaagcagatcaaggaggttgcgtctccgcaggtctccctgacgatgaccgtccgcgtacgcggtgcaacgccgttcctggtaaacgaggtgcagcgcaacagccaggtaggcaagtcgctggtaaacggcaacagctatgtcaatgcgcagatcaccgacatgaagatcgatgattacaatcagcaggttaccaccgctgacggccgcattgtaacggcaaccgatccggagaagaaggatctggtattcaccatcacgaccaaggtttccaaggacacgcctgcaccggccatcggtacgcaggaggtgcgcgcaggccgcacattcattgtaaagaccaacgattttgagacgaccggcaacattgattcggtcgatattgcggataattaaagcctatgaaagcgttatttgaaaacagtctgttcgtgcggctgttgatgtgtctgcgcgcatggtaccacgagggcgctatcgcgggattctttaaccgtatccggcaggcgtacccaagctcggtgttctgccgtctgtggaataaattctgcgcggcaccgatatgtacctcggcgaacagcatctatgcgcggattctggcagcgctgcgccggtttgtcgaaaaactgggcggaattgcggcaaacagcctgatctaccgcatctgccttgccgtttggcggccgatcgagcgtgtcgcaggcggcggcctgatcggcagagcctgcaggttcgtcggcatgcgcggcctgctgctgatttgtctggcgatgtatctgccgctcgattccgctgtccgctgggtgtcggatgccggctatctgccgtcgtttgtggcgtccgtgtgggatgagtgtctgatgcttgctgcatttgcgtacatcctgtggcacatggcgatgaagcgtgcgccgctcggctcgcgtgctacgccggtggatgcctatctgctgctgttcatcgcggtcggctttttcctgatgtgtgcggtttcgccgaatacgcatatcgcggtagcaggctaccgtgcggttgtggagtacctgttctggttcttcctcgtcacccgcctgattgaaaacgaccgcgatttcgcggtattctacggtgcgctcgtcgtgatggcactctgtattgcggcgcacggcatttaccagtatatcgtagccgcaccgatcccgtcgagctgggtctctcagaccgaggccagcgtgcgtacgcgcgtgtactcgctcaccggcagcccgaatatcatgggcagcctgctggtgctgtttgccccgatggtggcaggacttgcatattacagcagtaaaatgtgggtcaaggtgctggccgtctgcgcgaccggcatgatgtgcctgagctgcattttcaccttctccaagggtgcctggggcggtctggcagtagctgttgtgatcttcgccatctttctggaccgccgcctaatcgcgctgatgggcgtgaccggtgtcggtgcactgctggcaatcccgtctattgcgaaccgcattacctatctgtttactgcagattaccttgcagcaagccgccgcgcaggtcgtgttattcgctggtccaagggtctcaagctgctgcaggagagcaatccggtgctcggcttcggcctcggccgcttcggcggcgcggttgccatgcagaacaaggtcatcgaggagaccaaggatttctcctacttctacatggataactattatctgaaaacgctggtcgagatgggttatctcggtctggcgttctttatcctgctgctgttcggtctggtgctgtggagcctgcgctcgatcggtcgtaccggctacaccaagggcgaccgcacgcgcgtgctggcggtttccatgttcgcaggcatgtgcggtgtgctggtgcactgttacttcgagaatatcttcgaggtgccgtatatgatggcgtatttctggagcatggcggcagcggttatgtacctcgggtacttccgaaaacgaaaaacctgattttttagagaaccttcgtgagagggttctctttttttctcggcactgactcggcggggcatacgaactgcgttagcgtgttcgcccttaacgggcggctccttttctgcaccgacctagcggggtacttgaaccgcgcgggcggttcaccctgtccgggcggtagtcttttttgctgaacctcagcggagggttgcgctctgcggagcgcggggattcgccgcccccgcggcgggagcgtgccgcgccccgcggcggggcaagagggtagacaccaaggtttctaccctcttaactcccgtttccctttgtttcttagcccggcaaaaatcggagagcggcgactgcttcgaaataaggggaacggcagaggattctttctaccgtaggggagcacagtgtgctcccatgccgaaacctatacgcagtgccggataccgttctgctacacatacgggctactctgcgcaggcgcggcataaccgtgccgcgcaaatccttggcacgttgtaacgcacggcatctgcgaatttagatgtctggtataatttatcctcgtaggtgctgtctataataacgcgctgacgaattgcgcggcactgctatgccgcgcctgcgaagacttttcggtctgtgtagcagtaatgtatctgacactgcgaataggttgagaaagatacggaagaaaaaatcctctgccgtttccctatttcggagcggtcacatgtcggcaatctgcgccagactatccaagggaaaggcaggagttcaaagaggaagggaaaccgcaggtgtcccttcctttttgcccctgcggcgggcgccgcacgttcctgcgctccgcagagcgtaaatcccgctgaatcgcaggcgaaaacctcgatttaacatagattttactcgaaaacacacactttacttaaacttaacgaactctcgcttttgcattttacaaaacttccgtaagataatcttgtaacaaaaaacgaagacgaatgtaaaaggagaactaattatgaaaaagagcatttccatgcttctggcagcaatgatgctgaccggtgcactgagcggctgcggcggcagttcctcttccgcttcctcggattcccaggcaagcggcaatgacagcggcgtatccggcgcgatcaccgttatctcccgtgaggatggttccggtacgcgcggcgcgttcatcgagctgaccggcgttgaggagaagaacgacgcaggcgagaagatcgacaataccaccgcggatgccgagatcgccaacaagaccgatgttgtactgaccagcgtagcaggcaacgagaaggctatcggctacatttccctcggtgcgctgaatgacaccgttaaggctgtcaaggtagacggcgcagaagctaccgtagataacgtaaaggcaggcacctacaagctgtcccgtccgttcaacattgcaaccaagggcgagccgaccggcgtagccaaggatttcatcaacttcatcctctccaaggaaggtcaggctgttgtaaccgataacaagtacatcgctgttgacgacaatgcagcagcctttacttccgacggttcctccggccagatcgcagttggcggttcctcctcggtatccccggttatggagaagctgatcgaggcgtacaaggctgtaaacccgaacgcaagcattgacctgcagacctctgactccacctccggcatgaccggcacgatggacggcacctttgctatcggcatggcatcccgcgagctgaaggacgacgaggctgcacagctgaccggcaccgccatcgcacttgacggcatcgcagtagtcgtaaacccggcgaacaccattgacgacctgtctatggatcagatcaagggtatctatgtcggcgacatcactgactggggtgacctcgcgtaagcgaattcacagactgataaaacagggcgaagcgattcgccctgtgcctgtataggagaaagatttatgaaaaactttcgggaaaacctgatgcacatggtatttttcctctgtgcactgacctccatcttcgcggtggtgctcatctgtattttcctgtttgcgaacggtgtgcctgccatgaaggagattggcctgctggacttcctcaccggcgcaaagtggaagccgggcaacgacatttacggcatcctgccgatgatcctcggcagcctgtacatcaccgccggtgcgatcgttatcggcgtgccgatcggtctgctgaccgcggtattcatggcattctactgtccgaaaaagctgtacggtctgctcaagccgtgcaccgagctgctggccggtattccgtccatcgtatacggcttcttcggcatggtcattatcgtaccggcagttcgtgcggtggcaggtgtggtcggagcggatatttccggctcgtccatcctggcggcgtccatcctgctcggcattatgattctgccgaccattatcggcgtgtccgaagcggcgctgcgtgcggttccgatgagctactacgagggcgccgtcgccatgggcgcacggcatgagcgcgcgatattcacggttatggtaccggctgccaagtccggcgtgctggccggcatcgtgctcggcatcggccgcgccatcggcgagaccatggcggttatcatggtagcgggcaaccagccgcgactgaccggcagcatgctcaagggcatccgcaccatgacggcaaacatcgtgcttgagatgggctacgccaccggcctgcaccgtgaggcgcttattgcgaccggtgttgtgctgttcgtattcattctgctcatcaatctggcattctcggttctcaaaaggaggaaggaagcatgacaagagaagctgtctctgctgcgaaaccggcagtgcgcgcacaggcaaagaccgaaaaggtgcacggcgccgcatctgcagctgtgctcaagggtctggtgtacggcgcggctgtgctgacctttgcggtgctgctgttcctgatcggctatatcctggtgacgggcatcccgcatctcaagccgtcgctgttccagtggaattatacctctgagaacgtctcgatgatgcctgccatcctcactacggttgaaacgaccgcgctggcactgctgctggccgtgccgctcggcctgttcactgccgtgtacctgaatgagtatgccaagcgcggaaacaagctggtaaacgtcatccgcatcacgactgagacgctttccggcattccgtccatcgtatacggcctgttcggcatgctgtttttcgtcaccaggctgcactggggatactcgctgctggccggtgcgatgacgctggtaatcatgatcctgccgctcatcatgcgtaccgctgaggaagcgctgatggcggttccggattcctaccgcgaaggctcgttcggtctgggcgccggacgtctgcgcacggtattccgcattgtgctgcctgctgcgggtcccggcatcctgtccggtgttatcctcggtatcggacgcatcgtcggcgagaccgcggcgctcatctttactgcaggcaccatggcacagattcccggtctgttccagtccggccgtacgctggccatccacatgtatgtgctctcgggtgaggcgctgcacatgaacgaggcaaatgctaccgcagtcgttctgctgctggtggtcctgctgatgaatacgctttccgctctggcagcgaaaaagctgaccaagaagtaaatggagaatgaacatggaaaataagatcgaaattcacaatatgaatctgcattacggcgattttcacgccctgcacgatatcaatctggatatcaaggagaatgagatcaccgcattcatcgggccgtccggctgcggcaagtctacgctgctgcgttcgctcaaccgcatgaacgatctggtggaaaactgccgtatcacgggcgacatcatgctcgatggtcaggatatctataagaactgtgacgtcaatctgctgcgccgccgtgtcggcatggtattccagaagccgaacccgttcccgatgtcgatttatgataacatcgcctacggtccgcgcacgcacggcatcaagagccgtgtgcagcttgacgagatcgttgaaacctcgctcaagcgtgctgctatctgggaggagaccaaggataacctcaaaaaatccgcgctgtccatgtccggcggtcagcagcagcgtatctgcatcgcgcgtgcgcttgccgcagacccggaggtgctgctgatggacgagccgacctctgcacttgatccgatctccaccgcgaagatcgaggaccttgtgctcgaactcaaaaaggattatactatcgttatggtaacgcataatatgcagcaggccacccgtgtttcggatacgactgcgttcttcctgcttggcgacatgatcgaagtggatgacaccgaaaagctgttctccatgccgtcggacaagcgcacggaagactacattacggggaggttcggctaatgagaaaccgttttgacaatcagcttgcggagatgaacaatgagctgatctcgatgggggcactgtgcgaaaacgcaatcgccagtgcggtaaaggccctgcttgagggcgatatcaagctggcggctgccgccatccgcattgatcaggagatcgaccgcaaggaacgcgaaatcgagtccatgtgcctcaagctgctgctgcagcagcagccggttgcaagcgatctgcgtctgatctcgtccgtgctgaaaatgatcacggatatcgagcgtatcggtgaccaggcaagcgatattgcggagattgtaacgtatctgtccggtgcgtgcggtcacaacacgcatattgaccagatggcgcaggcaaccattaaaatggtgaccgacagcctggatgcgtttgtccgccgtgacctgacccttgcatggagcgttattgaatatgatgatgtggtggaccgcctgtttgacgagtgcaagagcgaccttatcgcggagatcgcgcagaacccggaggacggcgagcgcgtactcgatgtgctgatgatcgccaagtatctggagcgtatcggcgaccacgcgaccaatattgccgaatgggtggagttttccatcaccggctcgcataaaagcgcaatgcacggcgcggaagcggcggcgcgctgacagaaatcggagtgtaacatatgatatactgtgtggaagatgatgcgggtatccgcgaactggtggtgtacacgctgcgcaacaccggttttgaggctgacggcttcggggacggtgcggcgctgaccactgctctgaaaaaatgcaagccgcagctgattctgctggatatcatgctgcccggcgaggacggcatcaccattctgcgtcgtctgcgcgcagcgccggatacggcgaagattccggtcattctgctgactgcgaaaaacacggagtacgacaaggtagtcggtctggacaccggtgcggatgattacattcccaagccgttcggcatgatggagctgatcgcgcgcattcgtgcggtcctgcgccgcaccgaggatatgcaggacaaggatgagccgcgtccgctggtagccggcggcatctgtgtggatgagcgtgctcacaccgtattcgttaacgagcaggaggtgcagctgacgctcaaggagtaccagctgctgtgcctgctgatgaaaaaccgcggtgccgtgctcacgcgcgatgtgctgctcgagaatatctggggctataataatgaaagcgaaacccgcacggtcgatgtgcatatccgcacgctgcggcaaaagctgggcgcggacggtgcgctgatcgagactgtccgcggtgtcggctaccgcatgggagagcacacatgagaaagcgcgtattcggcagcattttcctcacatcgcttgtcacgctgctgctgacgaccgggctgctgctgctggcagttcacgccggtctgaccaatgacatgcggcggcggctggtgacggagagcagctacctgtctgcggtggataacatccgggaggagctggagaagttcggctcggtgtacgccgaccgtttgacgctggtcgcgcaggacggcacggtgctgtacgacaaccgcacgaatgcctccgagatggagaatcacgccgtccgtccggagattgcggcggcagagaagaacggcacgggtgaggacaaccgtctgtccgaaaccttcgctaagcagacattttattacgcggtgcgcctgaaaaacggcgatgttctgcgtatttccgcaactgcggacagcgtgttcggcgcactgtcgaatgcgtcgccgtggattgtgctgatcatcctgctggcgctgctggtcgcggcgctgctggcaggctggctgaccggtctgttcctcaagccgatcgaagcgcttgacctgcatgatccgatgaagggcgaagcctatgacgagctgtcgccgctgctgcaccgcatggacaagcagaaccgcaaaattcaggcgcagatggacgagctgcagcgccgtcaggctgagtttgacgacattacggcccgcatggatgaaggtctggtactgttttccggcaagggcatgattctgttcgccaatcacgctgcgcgggcgctgttcccgcatgacagtgcggaaggcagctatctgacgctgtgccgcgacgcgaattacattcaggtggtcgagcaggcgctcgacggcaatggcgcgcacggcaaactcgagcggaacggccgcatttatgaacttacggcaagctcggtggaggagaacagcgcatggcatgctgccgtgctgctgattgtggatattaccgagcgcgagcgtgccgagcagcagcggcaggaatttacagccaatgtgtcgcacgaactgaaaacgccgctgaccagcatcatgggttatgcggaaatcatcgcgggcggcattgccaagccggaggacgtggcgccgtttgcgggcaagatccgcacggaagcgcagcggctgctggcgctcatcgaggatatcattcacctgtcccgactggatgaaggcggagaaacagtggcttttgagccggtggagctgtccgccctctgtgataccgtgcgcgaccgcctgcagagcaaggcagcaggcaagggcatcgcactgcgcatcgagggagaaccggctgcggtttccggtcagcgccgcacgctcgagcagatgatcttcaatctgacggataacgccatcaattataataggccgcagggcagcgtgacgcttacgaccggcacggagagcgggcgaccgttcgtgcgggtggcggataccggcatcggtatcgcgccggcggatcagcagcgcgtgtttgagcggttctaccgcgtggataaaagccacagcaagatgaccggcggcaccggactggggctttcgattgtcaagcatggtgcggcgctgcatcatgcggaggttgagctgaagagtgcgctcggcgaggggacttgcattactttgcggtttcctaaagaataagctgcgctctgcggagcgcgggagactgccgcatccgcggcggggacaaagaggaagggacacctgcggtttcccttcctctttgaactcctacctttcccttatttgatagcctgacgcagaccagagaccggcgacagcttcgaaaataagagtatgacagaggatttttcctctgctacggacggaccaatttcgggtccgtccttttcttataccttttcgcagtgtcggataccgtactgctacacatacggttaaatctacgcaggcgcaacatgaccgtgttgcgcaattcgttaatctggagtttacgcacggcacctacggattaggcgtttggcacaatttatcttcgcaggccttgtctgtaacaacgcgctaacgaatcgtgcggcacggttatcccccaggggaccctctcttgccctgcgggcaattcaccttgtgccgcgcctgcgcagacgaaaccgtctgtgtagcagtacgctatctgtgaactgcgaaaaggcggagaaagacacgctgtggtaacccgactgccgtttcccattttcgcagcggtcacatgtcggcaatctgcgccagaccctctaagggaaaagggggagaaaatcagagggtggaaaaccgcaggttgtctatcctcttgtgcgcccgcgcggcgtcagcgcagttccgttcgcctcgcaggcgaaatcccctcaaaaaagaaaatctcaaaaaaataagaatttttgaaaaaaacacttgcgcgatacacccggtgtagtgtatactaattacagttgcgcaaatgcgtaaccgaattgccgcgcaaaggagtttctcctgcgcacgcccattggccatcaaccggattttcccggcgtggtccctggtgcggtccaaaaacggccgacctgccgttataccgggtaatcaagcaatttgactgcaaaacaggctaaaactgcgtaaaaatcagcactttttccgattgcagccattggtttctcgtgctataattaacgctggtctggttgagtactggaccggcgattttttatccccgccgctgtccgtggaagggccacgaacagtgtaaagaaaagtggagggcaaacagacaaatcagaaccggattaacccaccggcgctcgattgctgcactacccccaaacttcttatattaaaggagagcattttatgcagatcactgatcctatcgcggatatgctgactcgtatccgcaacgctggcaatgctcgtcatgccagtgtggatgtacccgcatccaagatgaagaaggctattgcccagatcctgctcgacgaaggctacatcaagtctttcgaggttgtagagggcaacacccagggcattatccgcatcgcactgaagtacgttgataaccgccagaaggctatcaccggcatcaagcgtgtgtccaagccgggcctgcgtgtatacgctggcgcacaggagctgccgaaggtactccgcggccttggtattgccatcgtttccacttccagaggcgtcatgaccgacaagaaggctcgcgagctgaacgtcggcggtgaagttctcgcatttgtatggtaagggaggtataaacaatgtctcgtattggtagaatgccgattgccatcccggccggcgttgaagtcaagattgacggcagcgttgttaccgtgaagggcgctaaggcaacccttacccgcgaatttcatccgaacatgaccatcgcggtagagggcaacgaaatcctcgtaacccgtccgaacgacgacaagcacaaccgcgcactgcacggcctcacccgcagcctggttcacaacatggttgttggtgttaccgaaggcttcaagaaggagctgagcgttcagggcgttggttaccgtgtcgctaagcagggcaaggatctggttatgaacctcggctactcgcatcaggttaccatgagcgaggtagagggcatcacgatcgacgttccgaacccgaacacgatcatcatctccggtcctgacaagcagaaggttggccagtttgcagcggaagtccgcgagaagcgtccgccggaaccctataagggcaagggcattcgctacgctgatgagtatgtccgccgcaaggaaggcaagaccggcgctaagaagaagtaaggaaaggagaggcgaaaataaatggtttcgaagaaggattccaacaaggcgcgccttcagcgccacaagcgcgtacgcgctaagatcagcggcaccgctgagcgtccccgtctggacgtattccgttctgcaaagaacatctatgcacaggttattgacgatgtagccggtgtaaccctcgtatccgcctcgactgcagagaagagctttaccgagtacggcggcaacaaggaagcagccaagaagattggtcagatcgttgccgagcgctgcaaggctaagggcattgagactgtcgtgtttgaccgcggcggctatgtgttccacggccgcgtgaaggagctcgcagatggcgcccgtgagggcggcctgcagttttaatcgggaggaggtaaaacatggctcagtttaacagaaacgataagcgtgaggacgagttctccgagaacgttgtagcgctcaaccgcgttgccaagaccgttaagggcggccgaatcttcaagttcgcagctctggtcgttgtaggcgacggcaagggtactgtcggtttcggcctcggtaaggcttccgaggttccggacgctatccgcaagggcatcgaggacgccaagaagaacctcgttaagatttctctgaagggcaccaccatcccgcacgaggttatcggcgagtttggtgcaggccgcgttctgctcaagcctgctgctcccggtaccggcgttatcgccggcggcgctgttcgtgcagtagttgaggctgctggcatcaaggacatccgtaccaagtgcctgcgttccaacaacccgcagaacgttgttaccgcaacgatggaaggcctgaagagcctgcgcgacgcagctcaggtagctgctgtacgcggcaaagccgtagaagaactgtaagaaaggggtaactgacaatggctaacatgaagattaccctgaaaaagagcctggctggtcgcttggagaagcacatcgcaacggctcattctttggggcttaagaagatcaatgacgtaaccgttcagccggacaacgcgcagacgcgcggcaaggtaaagcagatcggttacctgctcgaaatcgtagaggaggcgtaacccatgaagctgcatgaattgacgcctgccgcaggcgctaccaagccggcataccgtaagggccgcggcgctggttccggcaatggcaagaccgcaggtcgcggtcacaagggccagtgggcccgttccggcggcggtgtccgtccgggctttgaaggcggccagatgcctctggcacgtcgtctgccgaagcgtggtttccacaacattttcggcaccacttacgcaccggtcaatgtttccgcactggagaagtttgaagacggcgctgaggtaactgcagagatcctctgcaatgccggcatcgttaagaatgctctcgacggcatcaagatcctcggcaccggcacgctgaccaagaagctgaccgttaaggcagctgctttctcggcttccgcaaaggagaagatcgaagccgcaggcggaaaggccgaggtggtttaaggtgtttcaaacccttaaaaacgcctggtctatgcccgaactgcgcaagaagatgctgtacactctgttcatcatcctgatcttccgctttggttcgtgcattccggttccgtttattgataccacgctcctgtctcagtactttgagcaggcatcggtaaacggttcgatgcttggttatctggatatgttcaccggcggtggtctgtctcgtgcgaccatcttcgcaatgtccatcaccccgtatatcaacgcatccatcatccttcagctgctgactgttgccatccccgctcttgagcgcatggtaaaggacggcggcgaggaaggccgtgagaagattgcaagctggacccgttacctcggcgttctgctcggtctgcttcagggtctgtcatactacgcactgctccgcaacggtttcggcggccagactatgctgtccaacaccggcgcgcttgcagccgtaaccattatcgtaactttcaccgcaggcaccgcgctgattatgtggatgggcgagcatatcacccagaagggtatcggcaacggcatttcgatcatcctgttcgcaggtatcgtttcccgcggtccgtcgctcatgcgtacgctggctaacctgttccagaccggcacgagcggcatcgtttccggcattgtaatgattatcgtcggtcttgcgatcgttgtattcatcgtttatatgtcgaacgcagagcgccgcatcccggttcagtacgcaaagcgcgtagttggccgcaagatgtacggcggtcagtccacccacctgccgatcaaggtcaatgcgtccggcgttatgccgatcatcttcgcatcgtccatcctgtccctgccgcagaccatttcgatgttctggcagccggagagcggctcggttggtgcgcacattcttaacctgttctctcagaccagcgtgttctacattgtactgtacgcactgctgatcctcgcatttgcatacttctatgcatccatccagttcaacccgatcgagatcgccaacaacctgaagaagaatggcggcttcatcccgggcttccgtcccggcaagccgaccagcgacttcatcaccaaggcactcggcaaggtcaccttcgttggtgcgctgttcctcgctgttgtagcactgctcccgctgatcgtaggcgcagtaaactccagcctgagaaacgtagcactgggcggcacctcggttatcatcgtagtaggcgttgcgcttgatacggtgaagcagatggaagcacagatgctgatgcgtcatcataagggattcctggaataattctggaggctgtgttcaaatgaatttaattctgctgggcgctccgggcgccggtaagggcacgcttgcttcttacctgatcgagcagatgggtgtaccgagcatttccaccggtaacatcctgcgcgaagcgattaagaacaatactccgctcggccagtccgctaaggagtatatggatgccggcaagctggtacccgatgaagtggttatcggcatgctgaaggagcgtatcgctaagcgcgactgcaagagcggtttcatcctcgatggttttccgcgtacgattccgcaggcggaagcactcgacgagattgctcacatcgactgcgctctgtcccttgaagttgcagacgacgtcatcgaaaagcgcatgaccggccgccgtgtctgcctgcgctgcggtgcaacctatcacgttgaggcaaatccgccgcgcgtgaaggacgtttgcgacatctgcggcgataagctggtcatccgcagcgatgatcaggctgaggtcgttcgtcatcgtcttgaaacctaccatgagcagactgagccgctcaagggctactatgaagcccagggcaagctcaagagcatcgatggtgcgcagggcatcaccgctaccgaaaagtttgcagtagaggcgctgggtctgtaatatgattcatatcaagacagaaaaagagcttgaaaaaatgcgtgttgctggccgccttaccgctattgcgcgtaaggcggcggcagacgccgtaaagccgggtgttaccacctgggagatcgaccgcatcgtccgcaagacgattgaggatgccggcgccaagccgtccttcctcggctacggcggcttcccgggcagcgcctgcgtatcgctgaatgaccaggtcatccacggtattccttccaagcatgcagttgtcaaggaaggcgatatcgttaaggttgatgttggtgcatacatcggcggtttccacggcgactgcgcctgcacggttccgtgcggtgaggtaagcgaagaggcaaaaaagctgatcgctgtaacacgtcagagcttctttgaaggcattaaatttgcccgtgagggctaccgcgtatcggatatcggcgcagccgttcaggcatacgtcgaggccaacggcttttctgtcgtgcgcgactacgtcggtcacggcgtaggcgctgcgctgcacgagagcccggaggttccgaactacggcaaaccgggccacggcattcgcctgcagcgcggtatggtcatcgcggtagagccgatggtcaatgtgggtgtttacacggtcaaggtcctgccggatggctggacggttaagaccagggacggcaagctgtccgctcactacgaaaacaccatcgctattacggatggagagccggagattcttacgaatatcgacggcgaagtgctgtaatggcagagattcgtaccgccgacattgtgctgtcgctgaccggaagggacagaggacagctgatgctggtcgtcgcagaagagggggattttcttctgctggcgaacggacgtgcgcgccgggccgaaaacccgaagcgcaagcgccgcaagcatgtgagcctgcagggcccatgcgacgagcgcacacggcttaagctgcaaagcgaaagccggctgacaaacagcgagatccgcaaggcgctcgccctctggacaggggacgagaacgcaaattgaccgaggaggataaaccacaatggcaaaagatgatgtgattgagctcgagggtaccgtcgtagaggcgctgcccaatgcaatgtttcaggtagagcttcccaacggccataagattctggcgcatatctcgggcaagctccgcatgaactttatccgcattcttcccggcgacaaggtcaccgttcagatgtcgccttacgacctgacccgcggtcgtatcacttggcgttccaagtaagataaaaagcgggcggaggtacgcatgtgacctgcgcgccagtggtcgccggataggtttccggtgtcccatcccaccaaaaaatttgatggaggtaaaataacatgaaggtaagaccgtctgtaaagccgatctgcgagaagtgcaagatcattcgccgtaagggcaaggttatggttatctgccagaacccgaagcacaagcagaagcagggctaagaagcgcctgtggcgctttataggggacttcaaaagtcccctatatacaaaaacaagttcctgacgaaacttgtttttgatacccgaacgacgcgatccgagatcgctgagtcaaggtataaaaacccacgcacatgtcgcgggtttttatgatgactgcaagcagtcatcaataaatgcgcgccgaggggcgcggatcatggtttacgcgagcacgacaagcacgcacggcgagtgcggcgctgcaggagcggaggcggctcctatactgtgtttgcaaacacgcctcagtgtgtaactatggaggttataatagtatggcacgtattgccggtgttgaccttccccgcgagaagcgcgtggagatcggcctgacctacgttttcggcattggccgcaaaacgtccaacgagatccttgctaagaccggtatcaatccggatacccgcgttaaggacctgaccgaagaagaggctgctaagctgcgtgaagtcatcgagcgcgactacaacgtcgagggtgacctgcgccgtgagatcggcctgaatatcaagcgtctggttgagattggctgctaccgcggcctgcgccatcgccgcggcctgccggttcgcggtcagcgcaccaagaccaatgctcgtacccgcaagggcccgaagaagaccattgcgaacaagaagaagtaaggaggggaacgtataaatggctaaggtacagaagaagggcgctgcgacccgtactcgtcgtcgtgagcgcaagaacattgaaaagggcgcggcacatatccgttcctctttcaacaacacgatcgttaccattaccgacctgaacggtaacgctatttcctgggcttcctccggcgaaatgggcttccgcggttcgcgtaagtccactccgttcgctgctcagactgcggctgaaaccgctgctgctgctgcaatggagcacggtctgaagactgttgaagtatacgttaagggcccgggttccggccgtgaggctgcaatccgtgcactgcaggccgctggcctcgaggttaccatgatcaaggacgtaaccccgatcccgcacaacggctgccgtccgcccaagcgtcgtcgagtttaatagaggaggaaccaataaatggctaagaatacccagcccgttctcaagcgctgcaagacgcttggtctttcccctgcggtacttggttactccaagtccacgaagcgtcagcccaagcagagccgccgcaagcagtccgagtacggcatgcagctgaacgaaaagcagaaggtaaaattcatctacggcgtactcgagaagcagttccatgcttactacgagaaggctgagcgcaagcagggcatcaccggtgagatcctgctgcaggagctcgagcgccgtctggacaacgtagttttccgcatgggctttgctaacacccgccgtgaggctcgtcagctggttaaccatgcacacttcaccgtaaacggcaagcgcgttaacattccgtcttaccaggttaagccgggcgacgtagttgcagtttccgagaagtcccgttctaccaccaagttcaagtctctgctggaagagaacggcaagaaggcttgcccgaagtggatcgagaaggctaacgattccttcgagggcaagatcgttgcgatgcctgcacgcgacgacatcgattatgatgttgccgagcacctcatcgtcgagctgtactcgaaataatagaccctcgcttttggaacaggcgcggcgtctgcttcgcctgttctatcttaagtttccaaccaacgtgaaggagggtaccacatgatcgaaatcgaaaaaccgcgtattgactgtgaacagctcgcggaggacggttcctacggcaagttcgtcgtagagcctcttgagcgcggctacggcaccacgctgggcaactctctgcgccgcatcctgctgtcgtctctgcctggcacggcagcgtccagcatcaagatcgctggtgtgcagcacgagttttctacgattccgggcgttaaggaagacgttaccgaaatcgtgctgaatgttaagggcattattgccaagctgcattgtgatggtcccaagacggtctacatcgaggccgccggcgagggcgaggtcaaggctggcgatatccacgcagacggcgaggttgagattctcaacccggatctgcacatcgctaccctgatgagcgacgcacgtctgtccatggagatcacgatgacttccggccgcggctatgttccggctgagaagaacaagcagcatcagacctccatcggcgtcattccggtggattcgatctacacgccggtttataaggtgaactacacggttgaaaacacccgtgtacgcgacctgaccgactatgacaagctgacgctcgaggtatggaccgatgcaaccatcaacgcacgcgacgcggtttcgctcggtgcaaaggttctgcgcgaccacctcgatctgttcgtagacctgtccgaggaaatcggctccaagtccaccgttgttgaaaaggctgaagcgcagcacgataaggtgcttgaaatgaccattgaggagcttgacttctccgtgcgttcgttcaactgcctcaagcgcgcaggcatcaatacggttgaggacctcatcaacacctccgaggaggacatgatgaaggttcgtaacctgggccgcaagtccctggaagaggttatcggcaagctggaggctatgggtctccacttggcgaagtcggaagagtaatcttcggacactgtaacttgaactgctgcggcggtacgattaccgcgccgccgctttactttaatttggaggtaaactcacatggctaacaatcgcaagctcggccgtgctacggatcaccgtatggctatgctgcgtgcgctggtaacctacctgctggagaacggcaaggttgagaccacgctcgctcgtgccaaggaagtaggcccgctgactgagaagatgatcaccctgggcaagaagaacaccctggcatcccgccgtcaggctatggctttcgtaaccaaggaagctgttgttgctaagctgttctctgagatcgctccggagtacgctaaccgcaacggtggctacacccgcatcatcaagaccggcccgcgtcgtggcgacgcagctgaaatggcgatcatcgagctggttaagtaagttaatttttaacttctgacgactcgatctgttccaaaacagaaaaatgatcctaaaaaggttatccagtagcgtgcttattggataacctttttctttttgcttttttgcatcctgtatggtactatgtagataaatcgaaaggctaaattctgccgaacaggaaaaggagggccgcagatgtttgcaatgcagatgtttgatatattgagtttcatcgtccccatcatgtttattgtcgtatttggcatcatcattttttccatcatacaggggataagcacatggcataagaacaataattcgcccagattgaccgtaccggcggtgatcgttgcaaagcggacagatgtctcgcatcaccagcatgccaatgcaggtgacatgagcggagcgcacggcttccacacaacgtcgagcacgacctattatgtcacgtttcaggtagaaagcggagaccggatggaattccatgtttcaggcttggaatacggtatgcttgcagagggcgataccggcagactgatcttccaggggacgcggtatctgtcgtttgagcgatagcttttattcggaagggggcttgcgtacgccggaaaatattcaaatgatctgtctggtgcggcagacacgtatgaaaggtgccggttcgcgtacacatgatggtttcgctcggtgcggcgctgatgacgctggtctccttgtatggttttctgcctatcgtgggagcagtcggtgtttcggttgacgtttttcgtgtggcggcaagcattgcagccggtatcggcttccttggcgcgggcgtgattttcgtgcaccgcggcggcgcggtcggtctgacagacggcaaaggcgatcttgtgcgtctgtacgactggctggcacagtggaaaatcaccgtgcgagagatcaatctcaagcggcaggaaggcatttcgataaagcggatttctgcggctgcaggtgaatatcacgggtgtgcagtcggttgagagataaacggaatagcaaagccgttcggcagaaatgctggacggcttttgtgctggatgaataatatgatgttgaaaaaacaggatttgtttggtatactgtaacaaacaaataaagggaggtcccgctatgaaaaagagaatccccgcaatcatcctgatgtttgccctgttcctgaccacatcctatgcggcaaacacctatcgcaagacgatcaccgtcacgtccggcgtcaatgtggaattcaataacgaagcgatcgacatgacagacgccaacggtaaagcggtcgaggcgtttatctacaacggcacgacctatgtgccgattcgtgcggtgtcgaatgcgttcggtgcggatatcggctatgaccgcaatacgcagacgatttcgatttatgatgatttttctgaggtggccgccgttgcacatggaatgagtaacattcttacgggttactcagaggctatgtttgttggactggcgtatgttacaggcggagagcaggaaagcatacaaaatatgatggacaatatgcagacatccaatgctaacatgcagagtacattgaagtatctgtcttctgacgatggttacaacacttgtatcggattgctcgatgatgcagtagcaaaatataatagtgcaatcgcgtcttttaatacagcggcacagacatacgagcgttatgtacagaatggcagcgattactatgcagatgcgtttgatacagagtttaccagtgcatataacgcatataatgatgcgcagaacgcaatcacggacttcttttacgattacgctatgtggcgtgacgtttaaggacaataaataaaaggagatagagattatgtacctgaaagcaaccttagtcaccattgtaggctggtttattggaatggtgttagatgcaaacatcgatttcggagacccgatgggcttcctcagtctgcgcatcctgtttcctatcttggccatgggactgtgcatcctgcacgagctgagacgcggcagcagccgctaacccgcaaaatttgcggctcacacgcctaaatttgtgcattttcacggtaaaaacggatatttttattgcaaaaacgcttgcaatgtacggcaatgcgtgatatactatcagtgtaagatgataagtaaccgtaaggagtggccaagtgccactccttacgctttgctcggagaaaatttttcagtaaggagggacggctttgcaggcaaagcagatcgtagcccgcgtagaggaactggtaaagcctttgtgtgaacaggctggtgtttccctgtgggatgtggagtttgaaaaagagggcggacagtacatgctgaccgtcaccgtggatcgaccggagggcgtcaacattgaccagtgcgagcaggtttcgcgcgcgcttgatcccatgctggatgaaaaggaatttgacgatatgccgtcctatacgctgtgcgtttcctcggcaggtatgtcgcgccgcctcaagcgtccggagcatttccaggcgtttatgggtcagaccgtcgaagtaggcttttacaagccgatgaacggcatgaagcagatcgagggcacacttgccggctatgacaacggcgccgtaacactggaagtgaacggcgagcagaccgtatacgaacccaaagacattgccgcagttcgactggcggtagagatataagaaggagctgaataggaaaaaatggttaacgcagaattttttgacgcgctggaacagctggaaaaggaaaaaggcattccggtagactatatgctcgaccgtgtaggtcaggcgctgatcaccgcctacaagcgcgataacgacggcatgaccgacaatgtttacgttgagccggaccgcgacaagaagaccattcacatgtttgtccgcaagacggttgtcaaggcggaggatctgtacgagccgtacgaggagattactctcgaggaggctgccgagtacaagaataacccgatggtaggcgatatcattgatatcgacatcccgaccaagtccttcggccgcattgctgcccagactgcaaagcaggttatcattcagggcatccgcgaggcagagcgcggcatggttatctccgagttcgagagcaaggagcacgagatcctgaacggcgtggttgcccgcattgatccgcgctccggcaccgcttatctggatgttgtttccggcggcgagaagagcgaggctgttctggctgcttccgagcaggtgcgcggtgaggttctgactgagggtcagcgcctgaaggtttatctcatcgaggttcgccgcggcacccgcggcccgcaggtcgttgtttcccgcacccacccgggtctggttaagcgtctgtttgagctggaggtaccggaaattcactccggtatcgtcgaggtcaagtccatcgcgcgtgaggcaggcaaccgcaccaagatcgctgttgtttctcacgatgagaacgtcgatccgatcggcgcatgcgttggtacccgcggtgcgcgtgttgccaacatcaccggcgagctgaacggcgagaagatcgatatcatcaagtggaacgaggatatggcgcagttcgtttctgcggcactcgctccggctgatgttatcaatgccaccatgcaggcggacaacaagtcctgccgtgtcatcgttccggacgatcagctgtcgcttgctatcggcaaggaaggccagaacgcgcgtctggctgccaagctgaccggctgcaagatcgatatcgctcctgagtctcagggcgaataagcaagcggaggtgcggcagaatatggtacagaagaagattcccatgcggcagtgcctcggctgccgtgaaatgttcccgaaacgggagctgatccgcgtggtgcgttcgccggaaggcgagctttcgctggatttcaagggcaaggcacccggccgcggcgcatatctgtgcggcaagccggaatgtctgaaaaaggcccgcaagagccgtgcgatcgagcgcgcgcttagtgtagaggtgcccgagtcggtttacgaccagctcgagcagcagatggaacaggagggtgcaaatggcaactgatccggttctgagaatgctcggtctggcacgccgtgccggcaagctggcctacggcgacgagctggtgcgcgaggcgtgcttcgaccacaagacccgctgtgtgttcattgcgggtgacgcaggcgcaaatgcagcgaaaaaagccgcattttacgccgataaggcgaatgttccgtgcgtaacgctgccgcacggcaagctggaactcggcagcgcgatcggcaaggcaggctgcgcgatgtgcgcggtagcggacatcggcatggcggcggcagccgtaaacaagctggcggagcaggatcctgcatacgccgaagtggcgcagcagcttagcgaaaagaacgtaaagatccagtcccgcaggggcgtcaaaaagcataaggataaggcggaaaagaccgaggaagcgccggtcaagaccgaaaaatcggcagaggagaagccgaagcgcacctaccgtaagccgtccggcgagaagcgtccctatcggaagaacgatgagaataagcgtccttaccgtaaagccgacggcgataagcgcccgtaccgtaaggaaggcgaccgtccgtatcgcaagaacgacggcgagaagcgtccgttctgcaaggacggcgaacgccgcccgtactgtaaaagcggtgccggcaagccgagcttcaacagcggcaagcgcagcttccgcaataaaacgtaatttcccgcgccgcagcgcgcattccaatagcaaagcatagctttgcatcaaatgtgcgagctttgcccgtgcttttgataccagagcggagaaaagttttgacataggaggaacttttcgcagctttggacgtatccgaacattgttcggtacgtcctctctcgttcaaaaccgtggttttgaacgaagtgtgtaaggaggttattgcccatggcattagacaataaatatcgggtacacgaggtcgcaaaggacttcggcgtatccaccaaggagatcactgaaattctgacgaagtatcgctctgcaccgaagaatcacatgcaggtgcttgacgataccgacctgtcggtcattttcgagtatctcacccagcataatcaagtaagtgacatggaaggtacgctgaacgcacagggtgcatcccgcaagaagccggagcagtccaaggcggaaaccaaacagcagaccgagtccaagagagaggagcctatcgtgcagcagcagccgacacagagcaaggtaaagcaggttcaccgcattgatacccgcggcaccggtgacgtaaaccttgcaaaatatgatgatcatgtagataagctggttgacgcaaaggccgagcgaatggagtccaagggcagcaagaagcagaagctgaccaagaagtccgaccagcgctccaagccgttcggcaacaagcgccgtcaggaggagcaggagaagatgcgccgcctgcagcgtcagcagcagatggcagcacttaagaagattccggtaaaggtaatgattccggaggagatttctgtcggtgagctggcttcccgtatgaagcgcaccgcagcggatgttatcaagggtctcatcaagctgggcgttatggcgtccatctccgaggtgatcgactacgataccgcagccatcgttgcagaggaaatgggctgcaaggttgagaaggaagtacacgttaccatcgaggagcagctgttcgatgagcacgaggacaaggaagaggagctgcagccgcgcgatccggtcgttgttgttatgggccacgttgaccacggcaagacctctctgctcgacgcgattcgcaagaccaaggtcatcgagggcgaggccggcggcattacccagcacatcggcgcataccgcgttaagattggcggcaagccgatcaccttcctcgataccccgggtcacgctgcgtttacctccatgcgtgcacgtggtgcgcaggtaaccgatatcgctattctggtcgtagcagccgatgacggcgttatgccgcagaccatcgaggcgatcaaccacgccaaggcagcaaacgtgccgatcatcgttgctgtaaataagatcgacaagcagggtgcaaacccggatcgtgtgctccagcagctcaccgagtacgagctggtaccggaggaatggggcggtcagaccatcgtctgcaacatctccgcaaagttcggtcagggtattgacaacctgctcgaaatggtactgctgaccgctgaaatggctgacctcaaggcaaacccgaaccgcaaggcacacggtaccgttatcgaggcaaagctggataagggccgtggtccggttgcaacccttctggtacagaacggcaccctgcatgcaggcgataccgttatcgcgggcacctctgtcggccgcgttcgcgcaatgaccaacgacgacggcaagaagattgagtccgcaggcccgtccgttccggtcgagatcatcggtctggctgaggttccgggtgcaggcgacatctttgacgccgtagacgacgagaagatggctcgtgagctggttgagcagcgcaaggacaaggagaaggaagagcgcaacaagctgttccacaaggtaacgctcgataacctgttcgattccatccagcagggcgagatgaaggagctgaatatcatcgtcaaggcagacgttcagggctctgtcgaggcggttcgttcctctctcgagaagctgaccaacgacgaggttcgcgtgcgcgttatccacggtgccgttggcgccatcaacgagtccgacgttatgctggctgctgcttccggcgcgatcattgttggctttaacgttcgtccggaccgcaccgctaccgactccgctgcacagcagggcgttgatatgcgtatgtaccgcgttatttatgatgccatcgaggagatggagcaggccatgaagggcatgctcgagccgaagttcaaggaagttgttctcggccacgcagaggttcgtcaggtgttcaagatcaccggcgcaggcgcggttgcaggctgctatgtacaggacggcaagattcagcgtaacgctgaggttcgcgtagtccgtgacggcatcgtattccacgagggccacctgaataccctcaagcgcttcaaggacgatgtgaaggaagttgcaacctcttatgagtgcggcatgagcatcgagaactacaatgatatcaaggaaggcgatatcattgagtgctttgttatggaagaagtgaagcagtaaagcgcttcttctaagggggacgctgtcccccttagataccaaattggttcccaaggaaaccaatttggataaccccctctcgtttgcacggcaaacgaggccgtgccgccgcggcacgggcagtggtataaacatcgggcaaagctcgatgtttatagggaattgaatcacgcactgcggtgcgtgtgaaaatgcgcgatagcgcattttcctatacgaccggagggaatgtgcagagtggaaatagagaatcattctccattttccattctcaattctccattatttaaccaatcctcacgaaggaggtttgatttgtaaaatgtctactcgaattgatcgtatttccgaagaggtgatgaaggctctggcagaggcgatgcgctctgtcaaggacccgcgtgtacaggaggctatggtttccgtggtacactgtgatgttaccaacgatctgcgttatgcgaagtgctatatttccgtactcggcagcgagcagcagaccaaggacgtgatgaagggcctgaagtctgcggcaggctggctgcgccgcgaggttggccacaaggtacagctgcgctacgcgccggagctggtatttgagctggatcagtccatcacccacggtgcacacatctccgaggtgctgcacgagctgaaaaatgaaggcaagctgggagaggaggacgcagaatgatcgttgacgttgctggcgctgctgctgcgctgcaggcagcggacgacattctcatcctgactcaccgcagaccggacggcgacacggcaggctgtgccggtgcgctctgccgcggtctgcagcagattggcaagcgcgcatatattctggaaaatccggagatcaccaggcgatatgcgccgctgatcgtgccgtattatccgccggaggatttcgttccggcgtatgtggtttcgaccgatattgctgaggaaaagctgtttccggacacggcagagccgtacaagggcaaggtcgatttggtcattgaccatcacggctcgaacgacggcttcggcaaaaaaaacctcatccggccggatgcaggcggctgtgccgaggtgctgtacgatgtgctgacggcgcttggtgttaagttcacggccgacattgcagagtgcatttatatcggtgtttcgaccgatacgggctgctttaagttctcgaatacgaccgcgcattcgcatgcggtagcggcggcctgcctgactgccggtatcgacggcggtgagatcaaccgcgtgctgtttgagaccaaatcgcgtccgcgttttgagatggagcgcattgtatttgatacgatggagttccacgagaacggcgcgatcgcggttgccgtgctctggcgcagggatatcgaccatgcaggcgcggatatggacgatctggactcgattgcatcgcttacgcgtcagattgagggcgtacagatcggcatcacgttgaccgagaagccggacggcacggttcgcgtttccgtccgcaccaccaaggagatggacgcggccgctatctgcaagaaggtcggcggcggcggtcatgtccgtgcggcaggtgcgagcttcacctgcggcatggcggaggccaaggctgctatgctgaaggcggcagaggagcagtttcatgcagcaaagtgacctgaacggcattctgctgatgaacaagccgcagggctttacctcgcacgatgtggttgccaagctgcgcggtattctgcacacgcgcaggatcggtcacggcggcacactcgacccgatggcgaccggtgttctgccggtattcgtcggcggtgcgaccaaggcggcagattttgccgcagcgcaggataaggaatacgttgccgggttcacgctcggctactgcacggatacgcaggatgtcaccggcgaaatgctccggaccagcgaacgctatgccgcggaatacgcggtaaagcagatggtgcggcgctttatcggtccgcagcagcaggtgccgcccatgtactcggcggtcaaggtgaacggccagaagctgtacgacctcgcccgcaagggcagagaagtggagcgtccggcgcgcgatatcattgtgcacgaaatggacctgctcgacttcgacgagaatgcccagaagggcacgctgcggtgcaaggtcagcaagggcacctatgtccgcacgctggtcaatgaccttggcgaaaagctgggtacgctggccgtgctgcacagtctggagcgcacccgttcgggcgcgtatgagctggcgcagtgccatacctttgccgagtgtgagcaggcaatggcagagggcaccatgcagcagcttctgctgccgaccgacagcctgtttaccgatagacccgccgtttcgctcaccgatgagggcgcagagcgcattgcgagaggcgcagtcgtatttccgcgccagaccgacagcctgccggaaaccgcagataccatctgccgtgtgtaccatcaggataaattcctcatgctcggtcaggtgagagagctggataagggcggtttgggtctgtttgtatacaaaaacttccgataagtttttgcatacaaacagaaatggagaattgaaaatggaaaatggataatgaaggtatcgcgccttgcgcgatgatttaataagcgcgaagcgccgcattcattctcaattctcaattttcaattatcaattttttcagggggattcccttatgatagaagttacaaagccgcgtgccatcgcgctcggctactttgacggtgtgcatctgggccatcgggcgctcatgcagcgtgcggtcgagcgtgccaagcaaatcggcggcacgagtgcggttttcacgtttgatgtgcatccggattcggttgtcatgggccgtcaggtgccgttgctgaccgcaaatgcatatcgcaccgaggagatcaaaaagctcggcggtgtggacgaggttattttcggccactttgaccatgaaatgcagcacatggactggcgcgattttatccacaagctgctcatcggtcgcttcaatgcgggctggattatctcgggacgcaataaccgtttcggctataaggggcagggcaacgcagaaggcatggctatcgagtgcgaaaaggccggcatcggctatgactgcatcgaggatgtcaagattgacggcattgtggtgtcctccacctatattcgtcagctgatttcgcagggcgatatggaaggtgcggctaagtttctcggtcatccgtatacggtttccggtattgtggagcacggacggcgtgtcggcacaagcgtgctgcaggtgccgacggtcaatctgcgtctgccgaccgaaatggcgatgccgccgtacggcgtgtacgcaacccgcgttctggtggacggacagagctatatcgcagcgactaatatcggtgtaaagccgacatttttagacggcggtgcaccgaccatcgagccgcatctgctcgactttgcgggcgatctgtacggcaagatgatccatgtggagctgcataagttcctgcgtccggaaatgcagtttgaatcggtggaggcgctcaagaccgccatcgaggaaaatgtgcagcagaccagagaatttttcaaagagaaataagaaaaggcggtatcgctgcatagcggtaccgcctttctgtatctcagggaacaatttggttgacaatcaagggatcgttcggtatcatcaaggtacaagaataaggatagagaatcgggaggaagacaatatgaagaaatcggtcaaatgtgcagtaacagcggcgctgctccttctgctttgtgcggttgggatctatggcatattctttgcaccacggaagatcggctgtgcagtcgatgattcgttttcgtggaaggcgtacagctatacgccggtgacgagcaaaacgatttataactatgcgttcccgtccgaagaaattacactttctgcggaaaatcgggagacgatcgtgcagctgcttgcagacagtaagggcaagcggcgctttccgggcagatggacaccgtacggcacgaataccaggattccgtgcgtcgttgcggtgcaaatagacagcgcggaagcagattatatgctctttctgtgcaggaatgattcggaagagttgctgctgctgaaaacagaactacatggcaaggacagatggtatacgctggagagtccggcgcttgcggcggctctgaataccctgtatccgtatgataccacaggcagcactgtaacgcatactgtcggaacaaactaaaaaagctgcggttaaaccgcagctttgaggctgtcgaaaaactccgtttttcgagcagcctctcgattgaaaccacgctttcaatcgaatcttgacgaaaagccgcgccctacgggcacaatttttcgtcccttgtataattcccgaggtacacgcccccgggaattatgaatttgctgtgcaaattctattttatgcgtgctgccgcacgaaaagtgaaaacgatagattgactttatcgacagactgaaagctgcggttaaaccgcagcttttttgccgcaaggcggaaaaaagccgcctgatgaatcagacggcgattttccctcaaagagcaggtaaagagtaaagaaagaaaaaagaaaaaaagagagcaaatgaaatataaaaaccaatgtggttgttggttattgtcgatttgttgtgttccttagaacaattattattatagtcgttttagataaaaatgcaatagattttttgtttaatgttccagagaaaatgcaaaagtttttgtgcatatactacaaaaataacgtctgtaaattgtagggaaacacaaaacaaagggaaaacaagccgaaatctcaaaaaatccggcggcagcgggaacgatttgccgctgcaaaacgtgttgctggtgaaaggaggagagagcaatgcagacaaaactcaggtcggacgcatttctgcagcaggcgatggacacctgcggcgacgtggtctaccgcttagctttgtgcagactgaacagccgcgcggacgcagaggacgtctatcaggaagtctttctccggctgctgcgggacgacaccgatttccgcgacaccgagcacctgaaagcatggctgctgcgcgtaacgctcagccggtgcgccgatcttcgccggtcggcgtggtttaagcgcaccgcgccgatggaagctgccgcggatgctgccgctccggaaccggaaagcagcagtgagctgtggcaggcggtacacacactgccggacgatcagcgaatcgcggtgtggctgcactatgtggagggctaccgcacagaggagatcgcggaaatggtcggctgccgtccggcaacggtacgcacgcggctgcatcgcgcaagaaagcaattaaagctggatttggagggatcttacgatgaagaacaactggaacgaactgaaggacatcaaggctccgcaggagctgaaggagcgcacgctggcagcagctcgtgaagcgcgtaagctgacgaacgaaccgctgcatgcggtgccgcgccatccgtggggaatggcaaagcgccttctggcggcagcctgcgcgttcggtattgtactgggcggcacggcggtttatcgcacgcataatggcaccgcgcagaccggcagtgcagccgtagcggacgccatcaatcacacattcggctttgcagcctatgccgccgataccggcgagctgcgtcagccgaaggacagcaagatcgtgttcgacaccggcagcggcgcggacgacccggaaaagggtttctactccggctgtctgttcaaggtgaccggcgagaatatcaaaaccatatccgcgaccatcgacaagggcgcagtctaccgcacgaaaaccgtcaaggatacatcggccgaccgcgacaagtgggtgcgctcgatgcatcagggcacgaaccccgaactcgacggtgccgacaccgtgatggtctggggaaacggtccggaggagggcgcagagcagatgtacgccgacctgtgctggaagctggacaacggcttcaccgacgagtatgatccggatgtcagctacggtctgtggctgcccagccagccggaaaccacggacgatgatctgcagggttcgtggcacaaggccgtggacggttttgagggcgcaaagctgaccgtcaccatcacctttactgacggctcggagcagacccgctcgatgacgctgcacaccggcaagctgggcgtggaatacaaggacgatacatccggtccgagccttaccggcgaagtgctgaccgatgagcaggctgcagcggaaggctatatctatggcgtctatgcggatattgagtaattgaagatatgtgccgttcgtccaaaatcatcaaaaattagtatagtgcatgaaaatttcctctgaatcttgtgttcaggggaaacttttttgcggaaaaatgggaatataccttgaaaaatacggtgttatcgcataaaatagaagaagtttagttcgtaaatgaggcgaaagtatgctcaacattgttttggtcgagccggagattccgcagaacaccggcaacattgcccgcacctgtgcggcgacaggctgtgtgctgcatctggtcgagccgctcggctttgctatcgacgacaagcgcatgaagcgtgcaggtctggactactggcatctgctcgatgtgcgtatgtataaaaatctggatgaattttttgagaaaaatccggacggccgctacttctatgcgacaacaaaggcgccgcacgcctatcatgaggtggaataccgcgacggcgactacctgatgttcggcaaagagacccgcggtctgccggaagcgctgctcatcgagcacccggaacgctgtgttcgcattcctatgagagagggcgcgcgcagccttaatctgtctaactcggtcgctgttatcgtgtttgaggcactgcggcagaccggctttgaaaatctcaagctcgcgggcccgttcccgcaggtataaaggagtttagaatggaaaagattcatattttgaccgattcctcgtcggatattccgcacgatctggtagaggcgcacggcattgagatcgttccgatcatgctgacacatgagggacgcagcttccgcgaatattacgacatcacatccgaggactactgcaggctgctcgagaccagcagcgagattcccggcacggccatgactacgccgaccgtattcctcgagtcctacaaccgtgcatttgagcgcggctgcacgcatctgctggcagtgctcatcaacggcaacggctcgggtacctatcaggcggcctgccttgcaaaatccatgtttgaggaggagcagggtgagggcaaaatgaccatcgaggtcatcgactccaagacatacacctatatttacggacacattgttgtcaaggctgccgaaatgcgcgagcagggcgagagctttgacgcgatcgtcagcgtggtaaaaagccgtcttaaccgcgtggaagcctacctcggtgtgtacagcctcaagttcctcaagaagtccggccgtatttcgggcggcgcggccttcgtgggcgaggcgctcggtctcaagcccatcagccatgtgtatgacggtgctgtaaaggtgtgtgacaaggtgcgcggtgagaaggcactcgttgccggaatgagcaaaaaagtctccgcccgtgtggtgcagccggataagcagacggctatcctgctctacggcgacgtacccgccgagcgtctggatgaaatggaaaagcgtctgcgtaccgaaattggattccgcgatgtggaacgcgtagcgatcggtccttcggttctgacaaatactggtccgctggcgatggctgtagcgtattatggaacgccgcgggattgatgcaaaaattgtgaatgttgtttaatatttcgcaactttttggcgaaaaacgcaaaaatcctctaaaagcgagttggaatgtgatgattttcacaattttgcttgcgaatggcacgaattacgagtataattctgtattggaaacggaattatttaagtaataagttcgtgcttttgttccttatcgtaactttataatacatcttaaaggagagggatatttatgcagtataacaagaagagcgttgaggatatcgacgtatccggcaagaaggtaattgcccgctgcgattttaacgtaccgcaggacgagaacggcaacatcaccgatgacaagcgcatccgtgcttcgctggagaccatcaactacctgctggatcacaacgctgctgtaatcctgtgctcgcacctcggccgtccgaagggcgaagtaaacatgaagtattcgctggctccggtcgctaagcgcctgagcgagctgcttggcaaggaagtcaagctggcaaaggacgttgtaggcgaggatgctaagaagctggccgctgaggtcaagccgggcgaggtcgttctgcttgagaatgttcgctttgaaaagggcgagaccaagaacgacgctgcgctggcaaaggctatggctgacatggctgacatttacgtcaacgacgcattcggcaccgcacaccgtgcacacgcttccaccgcaggcatcgcagattacctgccggctgtatgcggcttcctgatcaagaaggaaatctctatcatgggcaaggccctgagcgatccggctcgtccgttcgttgcaatcctgggcggcgctaaggtttccgacaagatcggcgttatcgaaaacctgatcgacaagtgcgacaccatcatcatcggcggcggcatggcctacaccttctccaaggcacagggtggcgagatcggcacctctctctgcgaggaagacaagatcgagctggcactcggcctgctcaagaaggctgctgacaagggcgttaagctgctcctgccggttgacaccgtttgtgcagatcacttcggtgcggacgctgctccggtcgtatacgaggctggcaagatcccggctgacatgatgggcatggacatcggcccgaagaccgtagagctgttctctgaggctgtcaaggacgcaggcaccgttgtttggaacggtccgatgggcgtattcgagtttgacaccttcgcagtcggcaccaaggctgttgccaaggcaatcgctgagagcaaggctgtttccatcatcggcggcggcgactccgcagctgctgttgagaagctgggctttgctgacaagatgacccacatctccaccggcggcggcgcttctctggagttcctcgagggtctggagctgccgggcatcgcatgcctgcaggacaagtaagtccattaggaacgctttatatcggagcgcgttctgttgagcgctccgtataaatacataaagatttaagacggaaaagtccgtccgaatgtttgaaaggggtaaaaccaacatgaatcgcagatatcgtaagaccattatcgccggtaactggaagatgaacaagactccggcagaggcaaaggctctgatcgaagagatgaagccgctcctgtccaagaccaagtggtgcgagatggttctttgcgtaccgttcaccgatattcaggctgctgtaaaggctgctaagggctccaagattgcaatcggcgctgagaacatgcacttcgagaagtccggcgctttcaccggcgagatctccgctgacatgctcaaggagctgggcgttaagtacgttatcatcggccactccgagcgccgtcagtacttcaacgagaccgacgaggcttgtggcaagaaggttcaggtcgctctcgagaacggtctgcgcccgatcctgtgcgtaggcgagtctctgaccgagcgcgagcaggacgttaccatggaagttatccgcaagcagatcaagatcgctctgcagaacgtagctgttgaggacatcaagaaggttgtcatcgcttacgagccgatctgggcaatcggtaccggcaagaccgctaccgcagagcaggctaacgaggtttgctccgctatccgtgactgcctgcgcgagaagtacggcgcacgcgctgcacgcggcatcaccatccagtacggcggctctatgaacgcaaagaacgcttccgagctgctggctcagccggacgttgacggcggcctgatcggcggtgcctccctgaagagcgctgacttcgctaccatcgtagaagcagctaaccagtaagataaggatacgggaaagggaaacgctccctcaccgttttgcggagggggacatggtgcatatcgtgtccccttttattctcttatcgttcgcttctgtaaaggagttttatcagtatgaaaaaaaccattatgccgggcatgccggaggtagaggtagtcgagatcaagacttccgcaccggttaatgttctggcagatccggctcctgcaaaaaagccggcggcaaagcgtacccgcaagaccgctgcggcaaagacaactgcagccaagactgaggcgaaaaagccggcagccaagcgcggccgcaagcccaaggcagccaccgctgctgccaagaaggcagagggcccgaagaagccgaccgctctgatcatcatggacggcttcggccaccgcgaggagaccaagggcaacgccatcgaggctgctaaaaagccgaatctcgataagattttcgcagagaacccgctcacctatatcggtgcatccggtctggacgttggtctgccggacggccagatgggcaactccgaggttggccacaccaacatcggtgcaggccgcattgtatatcaggagctgacccgcatcaccaaggccatccaggacggcgatttcttcgagaatccggctctgatgagcgcgatcaaccagtgcaagtggtttggttccaccctgcacattttcggtctgctgtctgacggcggtgtgcattcccacattgaccacatgtttgcgctgctcgagctggcacgccgcaatggtctgcgcaaggtttgcttccactgcttcatggacggccgcgacacgccgccgcagtccggtatcgagtatatcgaccgcctgcaggccaagatcgacgctgttgaggtcggctgcatcgcaaccgtatccggccgttactacgcaatggatcgtgataaccgctgggatcgcgtacagaaggcgtacaacgctatcgcactcggcgaaggcgagcacgctgctaccgcacacgaggctatggagcagtcctacgcaaacggcgtaaccgatgagttcgttgttccggttatcgttaccgagggcgcgaccgtcaaggacgacgacgcgatcatcttcgcaaacttccgtcccgaccgtgcgcgtgagatcacccgtgcattcgttgatccggaattcaccggatttgagcgcgtacagcctaagatccactacgtctgcatgacgcagtatgatgctactattccgggcgtggaaatcgccttcaagccgcagagcctgaagaacacgttcggcgaatatatctccgatctgggtatgacccagctccgcattgccgagaccgagaagtacgcacatgttacgttcttcttcaacggcggcgttgagaaggagtatccgggcgaggatcgtgctctgatcccgtccccgaaggttgcaacctatgatctccagccggagatgagcgagcctgccgttaccgaggagtgcgtaaagcgcatcctgtccggcaagtacgacgttgttatcctcaacttcgcaaactgcgatatggtaggtcacaccggcgtattcgaggctgcagtcaaggctatcgaggctaccgatgacggcgtaggcaaggtcgttgacgccatcctcaagatgggcggccagtgcctgatcaccgccgaccacggcaacgtcgatcagatgctcgacgctgacggcgtgactccgttcaccgcacactccactaacccggtgccgctcgtaatggtcggtcacgagggcaagctggcagaaggcggcgtactggctgatctggctcccaccatgctggacatgatgggcattccgcagcctgcagagatgacgggccacagcctgcttgttaagtaagcagagtgaagagttgagagtgtagagtgaagagaaatcttcatttaacgctcggcaattcggatattcttattgataataatagagtgaagcagaaagagtgaaaaggcggagtaatctccactctccactcttcactctccactcttttataagctaatctattcttatgtaagaaggagaaagaattatgaagggctacattgaaattgttgatgtaatcggccgcgaagttatggactcccgcggcaacccgaccgttgaggttgaggtttacgttgagggcgacaccggcgcatacatgggccgcgctgctgttccgtccggtgcttccaccggtatcttcgaggcttgcgagctgcgtgacggcgacaagtcccgctacaacggcaagggcgtgctcaaggctgttgacgctgtaaacggcgagatcgctgaagttgttatcggcatgaacgctctcgaccagcaggcaatcgacaaggctatgatcgaggctgacggcactccgaacaagaccaagttcggcgcaaacgctatcctcggcgtatccctggctgttgccaaggctgctgcagaggctctgagcctgccgctgtacaactacatcggcggctgcaacgctaagaccctgccgatgccgatgatgaacatcctcaacggcggcgcacacgctaccaacaacgttgagattcaggaattcatgatcatgccggtttccgctccgtccttccgcgaggctctgcgccgctgtgcagaggtattccatcagctgaagaccaccctgaaggagaacggcactccggcagcaggtgtaggcgatgagggcggctacgctccgaacctgaagaaggacgaggacgctctgaaggttatcgttcaggcaatcgaagaagctggctacaagccgggcgaggacttcatgatcgcgatcgacgctgcttcctccgagtggtggaacgacgaggagaagtgctatatccagccgaagtccggcaagaagctgactcagcagcagctggttaagatgtggaagaacttcgctgagaagtacccgatcatctccctcgaggacggcatggcagaggaagactgggaaggctgggctatgctgaccaaggctctgggcgacaagatccagctggttggcgacgacctgttcgtaaccaacaccactcgtctgtccaagggcatcgagcttggcgttgctaactccatcctgatcaaggttaaccagatcggctccctgaccgagaccctggacgctatccagatggctaaccgcgcaggctacaccgcagttgtatcccaccgttccggcgagaccgaggacgcaaccatcgctgatatcgctgttgcactgaacgctggccagatcaagaccggtgctccgtctcgtaccgaccgcgttgcaaagtacaaccagctgctccgcatcgaggaagagctgggcgaggatgttgcacagttcctgggcaagaaggctttcttcaacctgaagaacaagtaagtctccgtccttaccgatactgcaatatgagaaaaccgcacgcttttgcgtgcggttttttttatagcaatttcttgcgaatatctagtaaattcttgcgcttgagttgacggatggacaaacctgtgctatcataaacgcagtagcatagcgaatcctctgtgctgaaacagagaatctggcttttttggataaaattgctcacattttcatttctttatcataaatcacctctgtgccttgtgcgcagaggtgatttattttttcggacagacgcggcttgaaaaaatcagccgccgtagccgttcttccatcgctgcagcgcgagcgctgcgttcttgtagctgacatcggcggtcggcgttccggcgggcacaccgaggatagctgcgtcactctgacgaacgtatccgctggttttccagcgttcaagcgcctgctcgtaggcacgggtctgtgcattcgcggccgcactgctgacattcagttgataattgcgccagttcagcgtcggcgtgccgttcaggaagccggtcagaccggctacggacaatccgtaatcgcggtcggcgttaaactggctcagtgccgcctgcgcctgctggagcgccgcattttccgatgcggtatagtagctgctctcggcggctgcggtctgttcatcggcagcattctgcgctgccgcacgcgcggacagacgcgcctgcccaagcgaattcaggtcgctgcggtaccggttgtccaccgcaatgcggctggtctccgccatgccgctggtggctgcctgcccgcgtgcgcccatgttaagtccgagtgctgccagcttttcctcgttgttcaccgcggactgtcgggcattgatgtcggtctgacgcataccggcggcgtagtcgttctcgatggatgcgagattgctctccagttgccttgcaatgcggctgcgggcggtctcaaatcgcttgaaacgggcattttccgccgcatcatacaggctgctgacgcggtttgcgccggttgttgtgcttgaaaccgagtacggacggtaggtgccgttccacgtcgaaaccgcgtcgttggatgcaaccttgccgccgagaccgagcgagtcaatcttgttctgacgttcgctcagcagctgctggcgtttcgccgaatcagtcgtgccggcgatcgccgccgagtagtcaaaattgtcgcggtagccgttggaattgagcgtgccggaggacgtgcttgacgtcgatttgcttgccgccgtcttagacgaagctgacttggacgcggctgactttacggttgatgttcggcgcgcggaagttgatttgatgattgccaaaggggaatcctcctttctaaattacggtctgaccctgtgtccagcggatggtgagcgcgagcagaccaaacggctcatccggccggtcgttgccgatgcgcacggcaaacagaggactgcggtgctgcttccatcgggtacggtacgtcacggcgcccggaatgcaccggaaggagaaccgtgaaaagtccagtgtgcggaaggaaaacaggtccatattgcgggaaagcgcaagctgggcaccgttttcgttctcgtactgcacggtcgcgcccgagcgggaatgcggcatgagcgtcggaatcacgtcccgcacggtcttgaagcggctccagtcggagagcggcagggtaggcgtgcgccagtacgcggcaatcgccgccgtgtcatcaagataggcgtgctcctcctcgcttttggcaaagcggcacagccggccgtctgccgtgccgaaccacagctgaccgttcagcaccgccagacactgtgcaggcacattgacccagaaaaaccatgccggatcgccgttttcctcggtcagagagccgtccgcgacataaatgtgtccgtttactgccagataatatttgccctcgaataccaccgcacaggcgtttttgaggtcggcctcctgcgataatttcggcacaatggcatcggataccgagcggatcgttcgctgttcggcaacggcggtgccgtacacgccctgcacacctcttgccgagagatatagcggcaggtcgttcagcacggcgaagcagcggctcgaaatcgcgccttcaccttgcgcaccttgcttgagcggatacagcgcagaaccgtcatccgccatcatgtaggtgcgcagatagctggtcgcctcctgtgcgccgccggacttgaccacgacctgactttcgtactgtttgagatagccgacgatcgcagatgcatccgtacccatgcgggtgtagccggtgtccggaaagtaggtcgggtcgtacaggccgctctgccagtcacagtccggctcatccgggttgccggaaaggaacacgcgcgtgtcgtttttgccgccgtatagcccggcaaagcggcatttgttgatcttgtccgcgtgtccgctgacggttttggcaaacgcgatggacacatttgccagaccgtttccgtttgccggagcagcggccagcgttaccagaccggtcgagcggttgaccgccgaaacggtaaccgccgagccgttgacctcagccgtaacagctgtttcgtcgagatcggtcgcgtccaccttgaactgggtcgctgtgccgtcaccgataaaggtgttgatgcgcttaggcgtcaagagatttaccgcctcgtagctggtgccgccgccggtcggcgccgcagagatggtcgtggtcggcacataggctgtgccggatacggaaacggcttcccataccgtgtttttgctgcttttgcgcaccgcacgataggttttgccgtccatcaggtagagtacaccattcatcgtaaacgactgggaaaacgcctcgttcatgtctgcgcacagctcggtctgcgtgccgtccggcgcccgaaaatacagctttgcacccgcatgtacggcacagcccacaccatccggcatggcgaataacccgtagatgggtgcgttaaactgcgcctgtgtgcgccatccggtgcgctttaccagaaaatcgttctggtcgcagatcatgttctgcatatccggcgagcgggagagggaaaccttggttggatgcgtgcggcagtcgatgccgccgaaccggctgaccacggtctgctgctcggcctccggatagggaaattcatagcttcgcattaaatcatctcctgcacggcggtaaactgcgcgggacagtgactcagcaggcgttcgctgtactcggttgccgcccagttaaacttggccttgtcgtcatccgcgacaagcagcgccgccagtccgtacggaaaacattcgcgcgccagccaatcgccggcgggcagctcctcggtcagcgctgtcatgcgcggcggcacaagcagcacgtctttgccgtcagacgcacgttctgcgttcatctcgcgcaggctgttcgctaacagctggttgagcgcaccgagcgcaaactgctcgtaatacacaccgctgtccggtgtttcggataaaatattcagcgctgcacgaaagcattcggttccggtcatagggttacctcctttgtgatgagttcattggatacagtgaggagttagaaggcaggagtggggagcaaacgaagaaaacctcctcactcctaactcttatctgctatttgaatttagccttccgctacctcggacggatacgcgccggactgcacgcagtatgcgcggatcttgcagccggtctccggcgtcagcacagtgccggcaacgtaatccttcgcggaatccgagtagcgcggatccgagccgtccagggtgtagcgcaccttgccgaacgcggtaatcttgccctggctgatggtcggtgcgctcgagcggcagtcctcatcgaccagtgcatacacgccgtcgcactttgcgccgagcacatatgcgtcgtagtagtgacggccctcgatcagtgcaccggacacgccgaccgggtcctcatgcaccttggcatccgcaatcttgtacggcatgagcacggcatccttgtgtgcaacgagaaagtacacgtcctccggcagatagctcttgggaacacggacgacattcatgccgaatacctcgccgcacacgcccttggcgatggactgacgcgccagcacgtccacaccggcaaactcgtccgaggtgcacaccagcttgtacatttcgctggtcaggtacagatagcggttgtcgtccggcacaagcgcatcgtcaagtgcctgcgacgcatccgcaatcttgctgatgatattcgccttggtcggctttgcactttccacaatgctgcccgccatggtgacgaagcgcttgaatgcgtacttgtccgccgccggtgtggacttctcgttcagctgcaggcgcagcatgtcggcggcattcttgaccagattctgatcgaggttgttgcccttgtcgatggtcagggtaaacgccttgtcctgcgtcatggtcagctcctgtaccacatcctgcatttcggtcacatcgccgtagcgcttcagaccgccgtcacggtcgtaatcgacctcttcgacggtgatcggggtgtaaaccttgagcgttttcacgccggtcaggtcatacgtctcggcagtcttgcccttgatgaaggacgcgcgggtgaatacctccgcaatctggtcggaatacttgcttgcgagattgatagccataaaattttacctcctatataaatgttcaatcgtgcagtaatggaaaattgataattgataatggagaatgaacacggtaattttccattttccattctccattttcaattcagcaaaagttacttgccgagcaaagcgagggtaaccgggtctactcccacgggttccccgtccgactgcgccggaccgaccgccgcacggcggttcttctggttcatctcgagcgctgccagttcgtctctcagttcggcaatctcccacttgcggtacgcggacacgagcgagccttcctgctgcgcccactcccatacctgctgcggaatgtcctcgggacggacatcgggatattcctcgacgaaagcggcgtagatctggccgttcggcatcgcgtttgccgcacgattacggcggatgtaggcgttgcgcttggaaaggccctgtgcggctgcgtcgatcagctcctcgagcgtcagttcgacgatatcgccgtccacctcgaccggataggtctgcgcattttcctgcggctggatttccgccgcctgctcctgtgcgaacggattgaccgtcatttcctgctcaggatggggattcactgtggttttctgcattactgtttgcctccttttgctgctgtcgctgtacgcgaagtgcgtgcagcaggtcgtgtttgccgcgtacctgataatccggtacgttttccagatatacgagcgggtcggaaataacgccgctctccagcagatgatcgtttgtcatcgtctgcatggtttcggaccagtagcttgccgcgccgacatccacctgcaggcgcatgtcctgtccggcgagtgcggagaagtcgaacgtgcatttttcgggttcgccgccgtcctcgttcggcagaacgagcgtgcgcacgccgtagtgcgcacccatcagatcgagaaacacgcgcgcccagtcttcggtaaagcggtagaactccattttggtcagctcgagcggcgctgccgttgcgttctgcaccgcgataatcgccgaggtgttgtccggattgaccgtgccgagtgcggcctcgcttgcgcccatgagctctgcggtatcggtcatcatttgcttgagcagctgcagcacctgtgccgagatatccggtgcgcggaatgcggcagcgatcgcttcattcgggttgccgcgcatgccgatcgccttgccgacgtcgttcgaccagccgttcgggaaccgcgtcatgtcgtacacgatcttagggaacgccacctgcttgatgcactggacgtacatcgagtacagcttgttgatggcgatctgattcggaatcgcctcggtcagcggactttcgccgtggcacgagccgcgcacgcggttccagcaaaggtgcgtcaccggatacagccgatagggaagcaccttttcgcgcattacgaccgcgtttcgcgtggtcttgcagaaggcaatgccgttctcggtcctgcgcatgtgcaggagtacagtcacgcggtcgctgtcgcttgaggtgcggtaacgatggtattcgccgctgtcatccggccgaatggcttccgcgtcgctcgcagagatgccgttggcgcgcgcttcctgccgcacctcatctgcgtcgcgccgcatggcaatgataatatacggctggcgctgtacctcatcgcaggcggcgttgccgaagcagatgttcgtggaatcaatcagctccaccgcaatatcgcccttaaccgcctgaccggtctcaagcgcaggatcaaagtgcatgtagaagcacgcatcgccgtccacacaggcgtttttcagcagcgggcggccgagtgccttgacacccgaacgctcgatcgcggatgcaaacgcacgctcgagcacatgcgcggtctgccgaccgtccttgtccatgtcgaacggttgggcgcgtaccgccacatcgtcggagaccagcatggacacaaacaggttgacacagcggcgcagcacgttaaagatcagcgggtcgagcgactgcacgcgcagtccctcccactgcctgccgaggtaaaacgcctcgttgcgccgaacacggtcgtataaaccgattgagcgcttgtagtcgcggtcgcgctcatatttcttccagattgccgtcggtgacggatcaaatttcatcgttgtcctcctctcgtccgtagttcatcagcgccgccagatcgcggctgagcgtatcctccggcgtagattctgccgtgtgctccttcggcaaacgtcgcggcagaaccacaccgccggagatgactgcaccggtcaggaccagtattgccgctgataatgcgtaagttaagatttccattgtgacctcctcttggaataattgagaatggagaattgaaaattgagaattatggtatcgtgctttgcggaaattatgcggtgttgccttaattcgccgcgtagcggcgctcatcgtcgcagcgcggacggaactcgcgcaaggatagcttgtcgcggcgcggatggaactcgcgcaaggatagcgacatcctccattttccatcctcaattctccattcctgctaaaagttaagaaaatcgcagatttcacaatcgtaggccgactgcggcacagccttaaccggctcataaacggtcgcggcgtacccgcggagcgcatccggcgcatgggtcagctcgtgcggcgtgttcgctgtgtcagacggattgcgcttgtcgtgctgcagtgcaggcagcgtgcggatcagattgtggcaggtgtcgaaaatcgtcagcctgggacgaacggcgccgtccgtatccttgcgcggctgcagcagctcatgcagcgccagccatccggcgacgcgttcattgctgcttttgacaaaatccagtccgctgtccgcgaacagttctaccgcgcttctgccggtttcctgccgtcggttccacagatcgggcggcgcgagacggcagtcgatgtgttctcccgccgtctcacaggcaagcatctgcgccgctgcatccgaaatgatgagtcccggacggtagagttcgcggtagaccacgctgtgtccgtccggactttgcgcgatccaaagcgctgccagcatgtccagaccgtagtcgatggtcaggcagcgccgccagtcgtgcgggatggcatacggctttacaacatgcaggtcgcgtgagaattcgctgaaatactgtccctcgttcagttcccacacgccgtcgagcagtgctttccggtcggtgggagagagcagcttcaaccgcttctcgtagcctgcatctgccttgcggagaaacgggttgtcgcccagtcttgcgggtaggaacagccgcgtgccgccgtcgaactcgcgcacggtgtccggcggcatggagtcgataaaccggctcttcacccactggtgaccgacaccgccgggattggtcgtcgccttgacctgcttggggaatccgttcgtgccgcggatacgcgacagcagataggtgaactggctttcggtgaaatgtgtcagctcatcgaaccggatgacatcgtattccgcgctctggtacctggtcacgtcgctttccgcgtcgcagtacccgaattccagcgccgaaccgtttgcaaaatcccaccggtgctcactcaccttgtactttgcaatgcactgcggatacagccgcaaagccgccggtacaagcgagcgctccagctccggcatggtccgtcgcagcataagctgccgcgaacccggatagcacaccgcaaaccgcaaagcatcgagcagctgaccgtggcttttgccgccgcctgccgcgccgccgaacagggtttcgagcgtatccgactgcatgaacgctgcctgccgccgtgttacggggaattcgtatcgtctacgatccggaacacgatctccaccggctggacttcggtctgctcgccgcccagcattacgcctttgccgaccgtccggtcgagaatttccttgatcgcgctgagccggctgttcgcgggcgcttccgcatcgtctgcgatgtcgtacagcatgcggatcagccgatccggcctttcgttttcgctgcacatggcctcacctcctttcgatgagccatagaataggagcaaaatccgaatttgtcaagaacaaatgttcgattttttatttgcttgcaatttttgcccagctgcggtatgctgaataagatggaaaatatgcggcgcagcagcgccagtatcaggaggaaagaagatgaaaaaaatcgaccttatcgcgctcgatttagacggaaccgcgctcaatccgcagaatcaggtctctccggcgaccgccgatgccgtgcgccgcgcccgcgagagcggcatccacgttgtcgtgtccaccggccgcatctgcggagaggcgcgcgacttcgcgctcatgctcggtacggatgaccagatggtcacctcgggcggcgctacgctgtcgagcgtgtcgcaggagcgctgcaccatgcgtatgtccatgccgtgggaagctgccgtgcgtgcgtctgctgtggtggagcgcatcggcatgatcacgatggtgtatgtaggggagacgttgctcattactccgtatgatgatatcgaatttggcaagtataagtcgaatgaaggctatttaagcgcgaaaaaagttgtaccgtctgttgcggaatatattgccacaaaccacatttcggtcgataaaatgttcatccgcagccaggacccggtcatgctcgtgcgcgcccgtgcacagctggaacagattccgggtatccgcgtgatgagcagcgcgaccgataacctcgaggtcatcacgccggccgcggacaagggcgttgctctcggcatgctgtgccgcgagctgggcaccgacctcgaccacgccgcggccatcggcgacagcgaaaacgaccttgaaatgctgaacgccgtagccctcccgattgcgatgggaaacgcaagcgcagccgtcaaaaatctgtgcctgcgcgagacgctcaccaacgcccaggacggcgtagcagccgccatcgaccgcatcatcgcagagaacggctaaacgagcagaccggccgctgttttccggaaaaacagtggtaaaaaccggatttctatgctataatatacttgcagagtatccgcagaaagcggaaaaacggcgcagaacgccgtcagattgaatcacaaagaaagttgaaggatagaagttttggctgcaaggaaaaccacaactaaaaaatcgacgaaaagcgcgcccaagggcaagcgtgcggcacagccgcagccggaggaactcggtccgatcctgtcccgtccggtctggggcgcaatctggggcattgtcggtctgctgtgcctgctgtcgatcctgccgatcgacggcgtgctgctcaagtggctgcaccgcggcatcggtgcgctcatcggcaagggcgcgtatgtcatgccgtttgcgctgatcggcatcgccgtgctgctgtttgcgcgtcccaagggtcctgtgcgcctgcgcggaacgtgtatcgcgctcatgccgctgctgatcggcagtatcattcacgccttttcgtgtgcaaatgagtacgacctgtccatgagcacgctcagcggtctgctctctaccggcatggaaggctcgtccggcggtctgctgggcggcggtctgtacatcctgctcgagtgggcgctctcgtccatcggtgcactgctcatcctgctggtgctgttcatcgtgtcgctgttggtggcctgccggattacgccgcaggcgctgtacgacatggttcgtccgcccgagtacgaatacgaggacgaggaggagcgcgagcgctacgaagcacctctccagctgccgaacatccacgaggcggcagctgcgcatgcacagcgccgagaggaacgccgcgcacaccgtaaatccgactttgacatcccgatcgacactgacccgcccggagaggataagccgggagaggaactgatcgacccgcgaaagcgcaagggcaaggccatcgcaccggacgaatatctgcgctcactgcgtgataacgtgaagaaaaaggccggaagcattatggatctggtcgaaaacaagcagccggaggaagaatcggcgcatgtttccgagccggagcccgagcatgaggcggctcctgcaccgtcatccaagtcgaaaaagaccgagaacatctcggagaccgagcaggaagccatgaatatcgccatcgacgagagccagaaagcgcccatgccggtctacgactacccgccgatcgacctgctgacacagggcaagcacgcctctgtcgcgggcgcagaagccgagctgcgcgaaagctcggcgtgcctgctcgatacgctcgactcgttcaacatcgaggcgcagatcatcggcatcgtgcgcggcccgtccgtcacccggttcgagctgaccatcccgcgcggcatcaaaatctcgcgcatcaccgccctgtcggacgacattgcgctgtcgctcggcgcggcgaacgtgcgtatcgcgcctatcccggataaggtcgcggtcggcatcgaggtgccgaacaagacggtcaataccgtctttatccgcgagtgtatcggttctccggcgtttgcgaatgcgaaaagccgcctgtcctttgccgttggcaaggacatcaccggcaagccggtcatcggtgacattgccaagatgccgcacatgctgattgccggcaccaccggctccggtaagtcggtgtgcatcaactccatgctgatttcgctgctgtacaagtccacgccggaggaggtccgcctcatcatggtggacccgaagatggtcgagctgggcaactacaacggcattccgcacctgctgattcctgtcgttaccgacccgaaaaaggccgccggtgcgctcaactgggcggtcggtgagatggaacgccgctacaagctgttcgcagaccatcaggtgcgcaatctggtcggttataacgacctcatgcgttccgaaaaggccaaagcagagcagaccgaggacggtcatcccgagcagtatcaggtgctgccgcagatcgtcatcgtcatcgacgagctggccgacctgatgatggtcgccgccaaggaagtcgagaactctatctgccgtatcgcgcagaaggcgcgagccgcaggcatgcaccttgttgtagcaacacagcgtccgtcggctgacgttatcaccggtatcatgaaggcaaatatcccgtcgcgtatcgcgtttgcggtagccagccagatcgaatcccgtatcattctggatacgaccggcgcggaaaagctgatcggcaagggcgatatgctgtatgcgccgctcggcgagggcaagccgacccgtgtacaggggtgctttatctccaacgaggagatcgaagctgttattgcccgcatcaaggagaccagcaccgccgagtacagcgaggaaatcctcgagcacatcgagcagcaggccgagcaggtaggcaataacaagggcggcagcagcggcacgaacgacccgggcgacgatgaggatgaactcatcgaggaagccatcgaggtcatcatggactgccgtcaggcgtccacatccatgctgcagcgccgtctgaagctgggctattcgcgtgccgcgcgtatcatcgaccagattgaggatcgcggtatcatcggcccgtccgaaggctccaagccgcgccagatcctcatctcgcgtgaggactggcaggagatgaagctgcgccgcacaatgccgctggataagcaacagtaatggataatggagaattgagaatgtcgctatccttgtgctgattttcaattttcaattttccattctcaatttgctaaacaattctctcaggaggtaacatatcatgaagaagatcaacattgccgaaaagtctttcaatccgttcgacctgatcggtcagaagtggatgctgatttccgcaggcactgaggataagtggaacaccatgaccgcaagctggggtgctgtaggcgttatgtggggcaagccgagtgcgacctgctatatccgcaagagccgcttcaccaaggagtttgtagacgcaggcgagtatttcaccctgaccgtgctcaaggacggtcaccgtgatgcgctgaacaagatgggctccaagtctggccgtgacatggataagatgcacgagagcggccttaccccggtattcgtagagggtcagccgaccttcgaggaggccgagctggtactcatctgccgcaagcgcggtgtgaccgacatcgcaccggacgacatggctcaggaagtgcaggacaagtggtacggcgatcacgactaccacaccatgtatatcggcgagatcgtagccgcttacgagaattgatttcacagaaaattcaccaattcctcatggttttggtgtattatcaagaaaagaagtacagggtcgctctgcggccctgtatcccaatccacaaacccacgcctcaaaagggaggaatgcaattcgtgaaaaaacgattgttcagtctgatcacaacggctgcgctgatggtcggcatgctgcctgcggcttttgcgggctatgaaaactttacctcaaaaacaacgtatcctgccggacagttcaccgacgtgccctcaaccgagtggtacgcgcagaatgttcaggcggcgtatgaatacaagctggtggacggcgtaaacgccacccagttcaagccgaacagcaacctgacgatcgcacaggcgatcaagctggcggcgtgtctgcacagcacctatgtcagcggcagtgcggattttgacaaagttcgtccgtggtatcagccgtatgtgacgtatgcattggaaaatggtattattaacacgacttatgcggattatgatcagccggcgacccgagcacagtttgcgtccatctttgcaagcgcgctgccggaggacgccctgaccgcgatcaatgacattgcggacggtgcgattgcggatgtggacatgtcggcaggctatgccgctgatgtgtaccgtctgtaccgggcgggcgtactcacgggcagcaacaacgcgcatgatttcaagccgaataccaacattcgccgcagcgaggttgcggctatcgtcacccgtatggcaaagccggatctgcggcagagcttcactgtggaagcacatgtcggcatgacggcggacgaggtgttcagtgcctgtgtaccggcgattttcaagctgtacgcctacgattataagaataatatcctcggcatcggcagcggcgttgtgctcagcgcacgcggcgatgctgtaacctgcggacacctggtcaacggcgtttaccgccttgtggctgagatgtacgacggcaccaagcgggaagtcacgatctacagctttgacgcggacgcggacatcgcgcatatccgtgtagtcggcagcacgctgccgtacctcggtgttaccactgaggtcgaggaaggcgacacggtctacgcgctcggttacccgggcggcggcgccgcaacggttacgaccggcaaggtgaccgacccggaaaacgacgattaccttgcaccgatgatcgaaagcacggcgcaggtcatcagcggcaactccggcggtgcgctcatcaacgatgagggcaaggttgtcggcattacggtcagcagccattccggcggcgtaccgtcttactcagtgccgatccgctacctgaacagcctgatcggcgacggcacggcgtactctcccggtgagtataaccgcaaccacaagccggatgcatcgcgctgctacagcaagcactatccggtgccggatttcggcacggtgaccggtgttacgctgctcggcaccatccgggagggcaccacgaccacctactactacgacagggaagaggtagaagccggcgacaagattctgctccactactacgccgcactgggtgaaaacaccttctaccagttcaccggcggctcgttcacctcgtcctcgacgtatccgtattcggtcaagctctacgagaccagctacgacggcatccctgcgatcagcgtcgtggtttccagcaattcattcgcttctatcggcggtctgcctcagaccgtcgattttcttttgcaggaatttgtgcattacgcctaatgaaatgaaagctgacaggcatggaacgtatttacgcccaaaatgccataaaaatcgagaaaaacgagaaaagataaaataaaattcggacaaaatttctgataaattaaaaagatagattttacgcaaacgtttgagttttggataaaaatacatgattagtcaaaatgcacaatatattcgtgggaaatcggtataatactacaatggaatatttcaccgctaacgtgctataatgtgcttgcgtgataaagagaatgagtattagagagagcatcaatcgaaacggaggaaatacccaaatgaaaaagtatgtttacatgttcccggagggcaacggcaaaatgcgtgagctgcttggcggcaagggtgccaatctggctgaaatgaccggactgggcatgcctgtgccgcagggtttcaccatcaccaccgaggcctgcacccgttattacgaggacggcaagaccatctatccggatattcaggatcagatcctgctttacctcgatcagcttgaaaagattaccggcaaaacccttggcgatcccgagaagccgctgctcgtatccgttcgctcgggtgcgcgcgcatccatgcccggcatgatggacaccatcctcaacctcggcatgaacgacgagatctgcgaagcagttgccaagctgaccaataacccgcgtttcgcacgcgactcctaccgccgtttcattcagatgttctctgacgttgttatggagctgcctaagtcctccttcgaacagtttatcgatcaggttaaggacaaaaagggcgtaaagatggacaatgagctcgatgcagatgatatgtccgagctgatcgtcctgttcaaggatcactacaagaagtccctcggcgaagatttcccgcaggacccgaagaagcagctgatggaggctgtccgcgcagtattccgctcctgggataatccgcgtgcaaacacctaccgccgcatgaacgacatcccgcacagctggggcactgccgtaaacgtacagtccatggtattcggcaatatgggcgagacctcgggcaccggcgtagccttcacccgcaacccggccaccggcgaaaagaagctgtacggcgagttcctgatgaatgcacagggcgaggacgttgtagccggcatccgcaccccgcagccgatctccgcgctggcagataccatgccggaggtttatcagcagtttgttgacatttccagccgccttgaaaagcattacggcgatatgcaggatatggagtttaccatcgaaaacggcaagctctacatgctgcagacccgtaacggcaaacgcaccgcacaggcagcgctcaaggtagcggttgatctggtagatgaaggcgtctgcaccaaggagcaggcggttatgaaggttgaggcaaagcagcttgacgcacttctgcacccgacgttcgatccggcagctctcaaggcagctacgccgatcaccaccggcctgccggcatctcccggtgcagcctgcggcgcggtttacttcaccgctgatgatgcagccaaggctcacaagaccggaatcaaggctgttctcgtccgtcaggagacctctccggaggatatcgacggcatggccgtatccgagggcatcatgaccgcacgcggcggcatgacctcgcacgcagccgtagtagcacgcggcatgggcacctgctgtgtagcaggcgtaaacggcatcaaggtttccgaagaggataagaccctgaccttcgccgacggcacggtagtacacgagggcgatgttatttcgctcgacggctccaccggcaacgtatacctcggcgagatcgcaacgcaggaggctgagctgaccggcgacttcggccgcttcatgggctgggctgacgagattcgcaccctgcacgttcgcaccaacggcgatactccgcgtgatgcaacgcaggcccgcaagttcggcgcagaaggcatcggcctctgccgtaccgagcatatgttcttcgagccggcccgcatcaaggcggttcgtgagatgatcatttccgatacgctcgagcagcgcaaggccgctctggccaagatcctgccgatgcagcgcggcgactttgaggcaatttaccgcgcaatgggcggtctgccggttaccatccgtctgcttgacccgccgctccatgagttcctcccgcacgaggatgacgagatcaaggagctggccgatgagatgggcgtaacctttgagaagctcaagggcaaggtagaaagcctgcacgagttcaacccgatgctgggcacccgcggctgccgtctggacgttctctatccggagatcgcagaaatgcagaccgaggccatcatttccgcagccatcaacgtctggaaggaagacggcctgcacatcaccccggagatcatggtaccgctggtatccgagatcaacgagctgcgctttgttaagaaggtcattaaggccaaggctgacgagctgatcgagcagtccggcctgaagatgaagtatatggtcggcacgatgatcgagacgccgcgtgccgcagtcaccgcaggcgatgtggccaaggaagcagagttcttctccttcggcaccaacgacctcacccagatgacctacggcttctcccgtgatgatgtgggccgcattctggagacctacttcgacaagaagatcctcgagtccgatccgttcgctcgtctggaccagaacggtgtaggccgcctgattcgcttcgctgttgcagaaggcaagcgcacccgcccggacatcaagctcggcatctgcggcgagcacggcggcgacctgtcctccgtcgagttctgccacaatgttggcctgaattacgtttcctgctcgccgttccgcgtgccgatcgcacgtctggcagcggcacaggctcgtgtaaaggaacttggactggcataaacctccccaaacttgacatacagcgcgaaaggcttcggagcattgctccgaagcctttcgtgttttttcatgcacaaatatgtgcaacagtgtttagagaatcgtagagcagcccgccctgcggaggagagttaccgaagaactaatggaaagggaatcttacagaaccttctccacatcctctgcaatctgctctgcggtgaggtgattgtccttcagtacctcgtctacgtcatagcggtcgagaaactccttcttgaggccgaagttcagcaccttaacgtcggaatcaccgtagaaacgcgcgatcttctctccgaagccgccgtcgagtacgccgtcctcgagggtgatgaccacgtcgtggtccgccttgaggctctcgagcaggtcagtatccacgccggtgatatagtacgggttgataagagtcggctgtacgccggtcttttccttgatgagcgccgccgcctgttcaccgagcgggtagaacgaacccagaccgatgacagcgacctttgcacccttctccttaaactcgtaggtgttcagcctgccgaagtccttagtaacagcctttccgtcggaaaccagtgcgccgcccggcatacggataacgaccggatgctcgttctgctcgatgctccagtcgagcatcgccagatattcttccttggtggtcggcgccagataaaccaggttggggatgttcgccagcattggaatgtcgtacagaccgagatgcgttacatcgttcatgccgtaaaccgaaccccacgcaacaataatggtagccgcgttgctgttgatgcacaggtcctgcgaaatctggtcataagcgcgctgaatgaacgtgctgtacacgccgtagaccggcttgccgccgtttgccgcaatgccggacgccagcgcaactgcgttctcctcggcgatgcctacgtcgataaactgcctgcctgccttcttgcgcatctcctcggtgaagccaagcacggtcggcgtacccgaggtgatcatgcacacagacggatcggcctgcatcctcttcatcataaagtcgagtgtaatgctctcgtagcactcgccgctcatgtccatcagcggctcgccggtctccggatggaacggagcacagtagtgccatgtctccttgtgctgctcggcaggcgcgtagcccttgcccttctgggtgacgatgtgcacaacaaccggctgcgtgctgtcctttacggccttaaatgcctcgataagcgaagcaatatcgttgccgttggctacaaagcggtaatccagacccatcgcgcggaacagattgcattctgccttgccgcccgtctcgcgcagcaggcgcaggttctgatacagaccgccatgattctccgcgatggacatatcgttgtcgttgacgaggatgatcaggttgccgtccagttctgccgcatagtcgagcgcttccagtgcttcgccgccgctgagcgagccgtcaccgatgatagcaaccacgttgccgtcctcgcccttgaggtcgcggcccttggccagaccgcaggccagactgaccgaggtggaggtgtgaccgatggtgaaatggtcgtgctcgctctcgtgcgggctgctgtagccggaaacgtcgtcgtagtgctcctcgtagagaaaagcgtccttgcggccggtcagcatcttgtgcgggtaggactggtgggaaacatcgaatacaaacttatccttcggggactcgaatacatagtgcagtgcgatggttgcctctaccatgccgaaattcgggccgaaatggccgccgtgacggctcagcttggtcagcagtgcatcgcgcatttcggacgcaagcacggtcatctgcgcaatgttcagcttcttcacgtcagcgggaccgttgatgttctcgatatacatagttttcctcctgaatatttttttctgaattaactctatcacttggagtgtgctccaagtcaagcggttttacgaaaaatatgcaaaaaataagagcacctgataccaggtgccttaatgctcaaatagatgcggaaaacgtttctccattcaccgtccagtgcgcttttccgtcctgtacatacagctcggagccgccgcgtctgcagccggcattcaggaaaacagctgtgccgtccggattcaggcggtagagattgtagccaaagtcctcggcagcgcggtaacgcgcggtgtgcccgaacacaaagccgaccatcgtgccgtcatcgagcgaaacatagttggtaaagtcaaaacccgcatacggcgtcgcgccaagctcggactgcttcatcagaccgcgctcgcgctgataggcaggggactcgagataagccatgctgtccgggtacagcatcgcgtacgagggatattttttgccggcagggacagcgccggcgccgacctcaccgacctttgtgccgcagttcatgcagaattttgcgccgtccggcagctgcgtgccgcagttcatgcaaaacatggtaatcgctcctttacatatactttagtatatcgggagagaggccgtctgtcaaatggccgtcacaggaaaactacgaaaaggcaaaagaaaaaccgtcttttcaaagaaaagacggttttcagtggcagccgaagaaggattcgaaccctcacaaacagagtcagagtctgtcgtgctacctttacacaattcggctatttgttaagttttgttgtcgttttgatgactcatcgctgacgacttgtttagtatatatcagaatccgggattcgtcaacccttttttcaaaaaaaataaaaatttttttcgaaaggggacaaccgtcgcttttacggcggccgtccctcgcgttcgagagcctcccgcagcttttcgagcgcacgcttttcaatgcgcgaaacatagctgcgcgaaatacccagccgcgcggcaatctcacgctgcggcaggggagatgccagaccgatgccgtaccgcaggcggatgatctcgcgttcacgcggagagagacagcctgccagcgcgcggtgcatggcatggtaccggtcctgctcctcaacggcggaaagaccgctgtcctcgcagcagataatatcctgcagggcaagcgcattgccgtcaccgtccgactcgagcgtgtccgagagcgaaagctcgcctgcactcttgcgcttctgccgaaaatacatcagcagctcgttctggatgcatttggaggcgtatgtcgccagccggatattcttatccgccttaaaggtgttcacggctttaatcagcccgatcgtgccgatggacagcagatcgtcctgctccgtacttacagcgtaatacttttttacaatatgcgctaccagtctgagattgtgctcgatcagcttttctcgtgcctcggcgtccccgtcttgctgcatgcggcgcagcagaaccgcctcctcatcgggcgtgagcggcttgggaaacgacccgtccgcgccctgtacacgcagcacaaagaagaaaaatgcaccgccgagcgcaaataaagcagggaaaagcatggtcagcacctcgtttcgataagatactgctattttatgcggcggatagattgcgtatcaccacaacgctaattatgtcgcgttatcacaaattaagggttgtaatttgacagaatatccagtataatatagtgagtatttacagcacattgcatagggaggtgtaaccatggttatggcattggataaaatgccggctctgtcggattacggcgcgatcatcgcacagtttctgccgtttgtagttctgattgtcgtattctactttttcctgatccgtccgcagcgcaagcgcgacaagcaggagcgcgatatgcgtaactccatcgaggtcggtgatgagatctccaccatcggtggttttatcggccgcgttgtcagcatcaaggacgacgttctggtcatcgagtcttcgagcgaccgcacgaagctgaagatttaccgctgggcgatccgcggtaaggaggctccggcgaccgagacggtcgaggcgcccaaggaagcaaagaaggacgcaaagtaataaccccatttcttgccgaatagcatgacatataaataaaattcggcgggaggctatgaaatgatgagaaaaaccaatgagggtcagtcgccggtcggtatccttttaccatcggtgcttgccggattgctcggtactctgctgctgatgctgctcggtgcggtgctcgttcaccgcggcacattggcagaaggggcaatagcgccttgtgcactggtgttccttgcactcggcagtgcgcttgccgcactggtcgctgcaaagcgcgcaggcgaaaaccagttttactggtcgctcggcgcaggttttgcggtttttctgatcctgctgatcgttgcggtgctgccgctcggtcaatccattcattttgtacgcacggtgatcagcctgctctgctcgttgatcgcctcggcactgggcggttacgccggtgccaatatgcggaaaaagaagcgttacagccacatcaaaaaataggagggaaatcaaatgaagcatatttctaccctgacttctgcaaccctgaagcagactgcagcacacggcggctgcggcgagtgccagacttcctgccagtccgcatgcaagacctcttgcaccgtggcaaaccagaagtgcgagcacgcaaagtaatcacgcttaaaaggaatatgcaaggcgcgcctgcgggtgcgccttgttcctgtatatcggaggaaaataaatgattcatcgttatcagaaaaaagggctgaatttcgtgctcgatgtcaactcgggcgcggtacatctgctcgatgatatcagctatgcagtgtccggactgctggatgaaaacatgggtgatacctgtccgcagagcatcattgacgccctgccggactacaccgcggacgagatccgcgaggcatatgacgagctgtacgagctgaaaaaggccggtcagctgttcgcgcaggatgactacatcgacgtaagccgctacattccggtgaatgcaccggtcaaggctctgtgcctgcatgtagcgcacgactgcaacctgcgctgcaagtactgcttcgcatccaccggcgactttggccagggccgcaagatcatgccgcccgagatcgccaagaaggccatcgactttgttatcgcgcgttccggcgtgcgtcacaacatcgaggtcgatttcttcggcggcgagccgctcatggcgtgggataccgttacccagacggtcgattatgcccgcagcctggaggagaagtataacaagaagttccgcttcaccatcaccaccaacggtctgctgctcgatgaggacaagcgcaagtacatcaacgagaacatggacaactgcgtgctgtcgctcgacggccgccgtgaggtcaacgacgagttccgcaagacggtagccggtacgggcagctatgacaccatcgtgcccaagttcaaggcgctggtggacgagcgcgacccgaacctcgattactacgcgcgcggcacgttcacttcgcacaacctcgattttgccgaggacgttctgagcatcgcggatgcaggctttgaccgcctgtccgtcgagccggtaacggcagacccgggctgcggatacgacttgaccgaggacgatctgcccaagatcgaggccgagtacgaccgcctgaccgacatcatgctcgagcgcaagaaggagggcaagccgttcacgttcttccacttcatggtcgatctggatcagggcccgtgtgttgtcaagcgtctgcgcggctgcggcgcgggctatgagtatgtagccgtaacgccggacggcgacatctatccctgccaccagtttgtcggcaaggatgagttcaagcagggcagcgtgctcgaccagtccttcaacatggacatcgcgcagaagtttgccggcatgaacatctattctcgtccgaagtgccagaagtgctgggcgaagttctactgctcgggtggctgctcggcagcaaactacaacatgaaccacgacatgaacgactcctacgacctcggctgcgagatggagcgtaagcgtctggaatgtgcaatttatctaaaggcaatggataaaatttgtgcaaatcagtcgaagtgatgaattgtaaaaagaatctgtaaaatccgttgcgaaacagactgtttgtgcgtataattgctcttgtatttgtactgccctgtgaaggagatgatattatgccgcagaatgtactggtttccgtgcttggtgaaggtgaatatcttcagaagctgatccgcgccatcctggagaaggaggtcgtaccgcagcgcaatctgttcctgtccgcgaagaatgcggcggcctgcaaggctgcagagggctacgacgaggttcgtatctgcgaggacgaacttgctgccatgatcaagagcgagattgtgctgctcaccgcttccaagcgtgaaatgccgaccgagcttgccaagatttccagcagttcgcaaaagcgcgtggtagtttccgtgtgcgacagcgaaaaggtggatcttgcgtacctgactgaccgcatcgccgctgcaaccgagttgatcgcggccgtgctgcaccgtgacgaggaaggcaagctgtatgcaacctacgagatcaacaaaaaggcacgcccgttcctgcgccagccctgcaaggacatggtggacgcgatgtgcgagatgatcaacgaggaaggctaagtccgtctgttgttctaaaaagataaaaccgggaatatgctgttctatgacttttccaagggggaagacgtatgaacaaacagcatattctcggtttttttgacgatttggtgcggacaccggtgttcctgttcctgtgtgcgatgttcctgtgcggtgcagcggcgggcggtctgaccggtctgcgggccggcgaaggggacggcgcggcagtgctttccggtctgctggctgaattgcccgcgcatgtggtgcagagcacgctgtgcgcgctcatatgggtgctgctgccgctcgtgtgcgcctttctgcgtccgagagagctgctgctgagtgcggttgccgcagcacgcggcttcgtgcttgccatgaccgtcgcggtcagcgtgggagaaggaaacgccctcatcatcggaacagccggcgtacccgccgtgctgagcgtctccgcgctgcttgccgcatgctctatggtctggcagggcggtgaagccaccggacggtattcgcttcgaacgtgcaggatgccgtatttcctgtgtgttacgcttgccgtgctgagcgcccttctgagggccgcaatagcggcactgtgtaatgtataagtttgtacaaaatgcacaaatgcacagcggaggcgatgcggaattgagaattgaaaatggagaatggaaaatgacgctatccttgcgcgagttccatccgcgctgcgcatgagacggttacatttgccatttattcattatcaatggtgccaatcggatagacggcggggtgagggcaccccgccctacggtataggttaaatctgtttcgtagggcgggctgccctcagcccgccgttttccaaaccatttgcacatatcttactgtagggtggctgatagttcacaattacgtcaattttccattctccattatccattctcaattatttaacccgaaaaatcccatatccattgacgcaatcttacgattgcgccttttttgttgcaagctcgacaattttatgctaatatttagttagattaacgaactaacggagggacagcgcgaacatggaagacgcagagcagctcaattcctttctggtcgatgtgttcggccggatcaacaaaatcgaagaacgcgccatggccggcggactgggcagcgcggtgtccatcaccgaaatccacatcatcgagaagatcggtgacagggaacctgtgcgtatgagcgaggttgccaggtcaatcggcgtaacactggctacgctgacggttgcgtgcgacaagctggtcgccaagggactggtgcgccgtgtgcgcagccaagaggaccgccgcgttgtcaatatcatgctcaccgacaagggcagagccgcctacgagtaccacaaggactttcacgagcgtatgatcgcgtctttggtggacacgctctcgcccgagcagaccgcgcttttagcgcagagcttagagaaactgcaggacttcttccgccacgaggaagcagccgtggagggagaaaccaatggataacctgatattctgtctgaatgccaccgtgccgatttttgcgatcatcgtgcttggccgctggctgcgcagcaaaaactttttcaccaagcagacgctgaccgacattgaccgtctgtcgttcaaggtgctgctgccgatcctgctgttccgcgatatcgcacagggacgcatcaccgagcagttcgaccccgtgtttttctttttctgtgcgggtgcgacgacggtgtatttttttgccgtctggatcggcgcgtccctctttcttaaagataagagtatggtgggcgcgttcacacagggcgctttccgcggctcgcaggcgatactgggtgtggcctttgtgcagaatctgtacggcaatgccggtcttgtgccgctgatgatcgtggcaagcgtgccgctgtacaacatcttttcggtgctggtgctgactgtcaccgcgccggacgcacagcaggcggaccaccgcggtctggtcggcaaaacgctgcgcggcatcatcaccaacccgatcatactgggtattttcgcgggtctgccgttctcgctactggcaatcgactttccgccgatgctggacaagggtctgtccatgctgggcagctgcgcaacgcctatggcgctgctgagcatcggcgcgggctttgagggcgcaaaggccatcaaaaagctcggcccgacctgtgcagccgtgtttatcaagctggtgctgctgagtgctatctttctgccgatgggcgtggcgctcggcttccgcgagcagacactggtggctatcgtcatcctgtgcggtgcgccgagcacagcctccggttatgttatggcgaaaaatatgggcggcgatcatgttttgtcatcgtcgatcattgtgctcagcacggcgctgagtgcggtaacgctgacattgacgctgtttatcctgcgttcgatggcgcttatttaacgtaagtttttcgccttcgaggcgaggggaactgcgctgacgccgcgcgggcgcacaagagggatggacacctaaggtttccacccctcttgtgaatctccccgtttccgcttagcacggcggctatcagagaactgagactatgggggaacggccgtactgttcatcttccgtaggggcggccaatggccgcccatttctcaaccgcagatgctcaagctgttttctgactgctacacagatcggcgactctacgctgggtgcggcacaaggtgaattgcccgaagggcaagagagagtcccctgggggataacagtgccgcacgaatcgttagcgcgttattatagacagcacctgcggatacaattcgcagatatagatttacatttcaccgtagggcggggtgccctcaccccgccgaatataacgacgtgcagatggtttacacggcggggtgagggcaccccgccctacggtaacatttaccggtatatactacccgtaggaactgtccgtaacaacgtgcaaaaagtttgcgcgacactgttatcccccaggggactctctcttgcccttcgggcaattcaccttgtgtcgcgcctgctggaagtagccggtctgtgtagcagtaagctatccgggaactgcaaatattttacgaaacaaacgcaagagtaacccgactgccgtactcctattttcgcagcggtcgccggtctctggtctgcaccagactatgacaggaaacgggtgattcacaagagggtagaaaccttggtgtctaccctcttgtgcgcccgcgcggcgtcagcgcagatttcgttcgcttcgcaagcgataactcataaaatcagcacagattttgcaaaagacgcaaagaaaggagcctccggccatgctgacttaccatctcaaaccgcacgaccaacagccgctctacgagcagctctaccacgctgtccgcgcggacatcatgtccggcgccttgcccggcggcacgcgcctgccgagcaaacgccagctggcggccaatctgcgcgtcagccagatcaccgtggaaaccgcttacggccaacttgccgccgaaggctacatcgcctctgcgccaaggcgcggctactttgtgcaggagcagcttgccgtgccggtttccgagccgcaggagccatttgcaccgcctttgccgccgatttccgcctctgaggagacctatccttacgattttcgcacggattttgtcgataacggctgctttccgttctccacatgggcgcggctgtcgcgtggtgtgctgagcgaatactcgagtgcgctgctccgtgcgaccgatccatgcggcgcggcggaacttcgagaggagatcgtgcgctacctgcacgacttccgcggcatcaacgtctcgccggacaacatcctcatcggcgcaggctcggagtatctgatgcaccttgtcattcagctgctcggccgcgaccgtgtgtatgcgctcgagaaccccggctaccgcaagctgtaccagattttcgcagtgaacggtgtgaccgtgcgttcgacaccgctggacaagcacggtctgcgtgctgacgcgctggacgcgagtgacgcatcggtggtataccttacgccgtcgcaccatttcccgctgggcacggttatgacggctgcccgccgactggaaatccttcgctgggcgtcggaagcgcccgaccgctacatcatcgaggatgattacgacagcgaattccgctacgcctcccgcccgattccggcgttaggcgagctggatcggacaggccgtgtcgtgtacgtcaacacctttgcgaaaagccttgcccccggactgcgcatcggctatctggtgctgccgaatgcgctgatggcgcgctatcgcgaacggttttcgcggtactcgtctaccgtgccgagctttgaccagtacacgctggcggccttcatgcacaccggcggcttcgagcggcacatcagccgcagccgcaagatctatcaggcacgccgcgacgcgctcatggctgcgcttgaccgcgagctggccgacctgccacatgaggtctcgcgctcggaagccggtctgcacctgctgctgcacatgcgcaacggcatgctcgagcacgaacttattgagcgcgcaaagacggtcggtgtgcgcgtttacccgctttcggcgtactatacgccgccggtcaagccgccgcgagcaacactcgtgctcggctatgccggtctgaccgaacagcagatcgacgaggcggcaaagctgctcaagcaagcgtggagttaatggaaaatggagaattgagaatggaaaatgaatatggaatttccatgaacgcgataatatacgcgtgaaacgcgttattgaatcatcgtgcaaagcacgataccacaattctccattctccattttcaattctcaattatagaaatccgaaggactgcgaatttttagcaaaaagtttgtagcacttcgggtttttatttcgtattaccggtgaaaggaggatggagcatgaccgcaaaaacacccgaacaactcgtcagcgtctacggtgacatggtataccgattggcgtatgcacagacgcgcagccgtcacgatgcggacgatatttttcaggaggtttttctccagaccgtgcgtaaacgaccggttttcgacagtgtggagcacgaaaaggcatggctgctgcgggtgacgctcaactgcctgaaaagccactggcgcatggcatggcggcggcacgacacaccgctcgatgaccgcattccgtttcccgagccggaggacagcgcgctggatgaagctctgcggcggctgacgcctaagtaccgcgcggcagtgcatttattctactacgagggttacaccgcagaggagattgcgcgcatgagcggggaaaaaccgtccgcgatacgtacacggctgacacgcgcacgggcacagctgcgcgaattgatgaaaggagagctggacgatggattttcacaagcagtaccgcggcatgaatgagaatatcacgccgagcgacacactggtgcagcagacaatcgccaaaatggagagcggcaggccgcacagagcgcgaaaaccgctcaagatcatccttgcggttgcggcggcactggcctgcgtgagcaccgccgtagccgccaatcaggaggcggttctgcgggtgctgtaccaaatcgcgcccggcatggcggagtacctgcagccggtcgggcaggtctgcgaggaccggggcgtcaagctggaggtcgtttcagcggacgtggaaggcagcacggcaaaggtgtatttgtcgctgaccgacaccaccggcagcctgttcggcgatgccgcaccggatctgtatgacagctggcatttggattatccgcgctggggcagagctgcaccgctgtcctgtggctgctcaacggttgactacgacccaagtacccacacggcaacgtattttcttcaaattgacgatttgggaggagatattccggcaggcgcgttcgagttttcgtttaacaagctgctgattggtaaagcggaacagaaaggtgttccggtaacggcggatttgtctgctgtgccgaaaaacgcaccgacagaaaatcatgagattaacggcctgagtacctcggatatctcgctgtacgaaaccatgcacgactacgattttcttgttcagcagggcacgctctggcaaagcgaggacggcaattttacgctcactgcggcagcgtggcacgatggtgcactgcacctgtcataccgcacggaaggcaagctgtcgcgcgacaaccatgcggattttgcggtactccgcatgacggacggcactgagctttggcgagattacgacgtttcctacgtcgattctgacgcggacgcagaagtcaccgagtacgttttcccgatggcatacgaggatgttgccggctgtacacttaccggtgatatctacaccgcaagcgaaatgatgaacggcagatgggcgatttccttccggttgacgcagtaacgcaacatgaggacatatccgatggatatgtcctcatgttttatccgttttatcctttttcttcaccgaatgcgcgaacacaacggattgatcaccgaatttctgccgcagtgcgtcgaccgtctggtcgagcttatgctggcggtcgcgcttttggatatcctcggcggcatcaaacagcgaaagctgctcgcacgactgattttccggcagcagattggcagccgtgaccgacagcaggcgcaccggcttgtccatcggccagtgcccgagcagcagctgcatggacagatcgatgagcgtccgcgtggagttggtcggccgctcaagcgttatctgtcgtgagcggttgtgaaattccgggtcacggatgccgagctgcacggtctggcacaccatgccgcgttttcgcaaacgtctgccgacattgtcgcacagcgccgtgatgcccatgcggcattcgtccgcgccgagcagattgtgcgcgaacgtcatgctgttgccgaccgatttgacctcgcgttccgcgtaaaacgagcgcaccggctcatcgtcctcgcctctggcgtaacgcagcagaagatcgccgtttttgcccagaatgctgtggataaatgccggatcgcaggcggcaagctcgccgatcgtgcgcacgcccagtcggttcagccggtcgctggcgcgtttgccgacatacaggagtgtgttcgcgggcaaggtccacacgcgctgcttgaaattttcgcgcgaaaagaccgtcgtgccgtccggctttttgtaatcgctgccgagcttggcgaacgcgcggttgaacgacacgccgaccgagatggtcagtccgacctcctcgcgcatgcggcggcgcagctcgtccgcgatatgctcgccggagccgaacaggtgcatcgagccggtgacatcaaggaaggattcgtcaatgccgaacggatcgacaagatcggtgtactgcaggtacagctcgttgcatttgcgcgaaaacttcacatattcgctccgatgcggtgctaccagccgtaaatccgggcatttccgtttcgcctgccagatggtctcggcagtttgtacgccgaaggctttggccttctcgttcttggcgagaatgatgccgtggcggctctccggatcaccgcagaccgcggtcggaccatcggcgagcgacgggtcgagcagcgtttccacactcgcgaaaaacgagttgcagtcgcagtgcagaatggttctgtccatcggtcatcatctcctttcgaacgaatgtttgcagtgtataactgcattatatccgaaaaaaatgtgcttgacaagtgggagaatgaggtgcatactgtatttgcaagcaagggtgccgtgatgagcggctgagagggcgagagcctaaccttttgaacctgttggttagcaccatcgtagggaggctgtcgcatatacttgaaattttaatgctccggttttaccgcatggtgagaccggagcattttttcttgcagaaaagaggatatttgcatgaaagtaaacggtaacgaacgcgctgttcccgcagaaggaaccgtactggcgctgctgaaggagctgggtcacgacccgcagcgtgtggctgtcgagaagaacggcaccatcattccgcgcgcgcagttcgcggaagagaagctgaccgatgcagaccatctggaagtcgtatgctttgtgggcggcggctgatacccttcgcaccaaaccacagtttggtgcgaaggggacatactgcgtaaaacgcggatatatcccaaagaaatttgcgcgccgcgagcggcacacacattttttactggtatgagaaccgagatacaagctcccggttttcatagaaattgcaaaaatgcacgctgcgcgtgattacaggagaaaaatcatgattttaaccaaagaacaactgcatgacgcactggtggaacgccacggcgcggatattcaggctaagctggacaaggcgtgtgtcggcattgcgggtctgggcgggcttggctccaaccttgcgatttttctggcgcggctgggtgtcggtcatctcatcctcgtggatttcgatgtggtggacatcaccaacctcaaccgtcagcattacacgatgaaagacctcggcattccgaaaacgctcgcgcttgttgagcagcttgaggccatcaatccctatctcacctacgagacctacaccgagcgggttgttccgtccaacgtggagcggctgttctccggctgtgatgtggtcgtggaggcgttcgacaagccggatcagaaggctatgctgctcgagaatctgcttaccagactgccggaaaagccggtcgtatcgggcagcggcatggcaggctacggctcggcgaacctgatcaagaccgaaaaacgcttcggccatgtgtacctctgcggcgacggtacaagcgatgtagccgacggtctcggtctgatggcgccgcgcgtagcggtctgctcggcacatgaaggcacgatggtgctgcgtctgctcatcggagaaacagaaccgtaaatagaaaatggagaacagaagccgcagctttcattctccgctctccattattctttcggctgatcggaaccgcaatgtgcacacttgacagccttgattggaatttcgctgcagcagaacgggcagaccttggtggtcggctctgcgggtgcttccggctttttgccgagcgcagtcagcttattgaccgctttgagcagacagaacagcacgaacgccatgatcaaaaagttgatgatcgaggtgatgaatgcaccgtagcgcagttccacaccgccgaggttcagcacgaaaccgcttaaatcggtgccgccgaacaggccgaggatcgggttgataaggttttcggtcagcgaggtgacgatgctcgtgaacgcgccgccgatgataacaccgatcgccatgtccatcacgttgccgcgcagcgcgaaggccttgaattcttcgataaattttttcacttttacgttcccctttcttatttatactatcagtttatacgtttcccttaaatgggtcaagaaaaaggagtttttcacatgaaagatacacttgtaatcggcggacatgaatttacgtcccgcttcatccttggttccggcaagtattcgctcgacctgatcaacgctgccgtgcagaacgcaggcgcacagatcatcacgctggcgctgcgccgcgcaaatgagggcggcacggctaacatcctcgactatattccggagggcgtaacgctgctgccgaacacctcgggtgcccgcaacgcggacgaggcggttcgcattgcgcgtctgtcgcgtgcgtgcggctgcggcgatttcgtcaagatcgaaattatgcgcgacagcaagtacctgctgccggacaatcaggagaccatccgcgcgaccgagatccttgcgaaagagggcttcgtcgttatgccgtatatgtaccccgatctgaacgttgcgcgtgatctggtcaatgccggtgcggcttccatcatgccgctggcggctccgatcggtacgaacaagggtcttgctacccgcgagttcatcaagattttgattgatgaaattgatctgccgatcatcgtggacgcaggcatcggccgcccgtcgcaggcttgcgaggcgatggagatgggcgcggcagctatcatggccaacaccgcgattgccaccgcaggcgatattccggcgatggctgaggcgttcaaacaggcgattgaggcaggccgcacggcataccttgccggtctgggccgtgtccgtgagacggcttcggcatcctctccgctgaccggtttcctgcaggattaaagttctcgattaaatgcgcgctttgcgcgaaaacagaaaggtatttgtcatggaaaacgaaaaaacggagatcatctccgcaaaatatatcactgaacaaaccaatcacatggagtaccagccgggtatggacaacatcggctccgaggtgcaggacgaggtcatttcccgcatgaacgcctatgacgcggatgcctatacggcggctgatgtgctgcgtgcgcttcgcaaggacgttctctcgccggaggacttcggcgcactgctgtctcccgcggcgctgccgttccttgagcagatggcgcagcgcgcacaggccgaaacgcgcaagcatttcggcaactcggtgcagatgttcacgccgctgtacatcgccaattactgcgaaaattactgcatttactgcggtttcaactgtcataacaagattcgccgtgccaagctggatatggacgaggtcgaacaggaactgaaggccatcgcggagaccggtctgcaggaaatcctcattctgaccggcgagagccgtgccatgtcgccggtatcctacatcggtgaagccgttaagctggcgcgcaagtatttccgtgtcatcggcatcgagatttatccgctcaacgtggatgagtacgcttatctgcacgagtgcggtgtggactacgtcaccgtatttcaggagacctatgacgaccagaagtacaaaaccctgcacctcggcggtcacaagcgcattttcccgtatcgcctgaatgcgcaggagcgtgcactgatgggcggcatgcgcggtgtcggctttgcggcactgctcggtctgtccgacttccgcaaggatgcgtttgcgaccggtctgcacgcgtatctgctgcagcgcaagtatccgcacgcagagatcgcgttctcgtgtccgcgcctgcgcccgatcatcaataacgataagatcaacccgaaggacgtacacgagccgcagctgctgcaggtcgtctgcgcctaccgcatcttcatgccgttcgcgtccatcactatctcgacccgcgagcgggcaggcttccgcgacaacatcatcggcatcgccgccaccaagatttccgcaggcgtagacgtcggtatcggcggtcactccggcgaggataagggcgatgagcagttcgagatctcggacggccgctcggtcgatgaggtgtataacgcaatctgcgaacacggtttacagccggttatggcggactatctgtacgtttaacgacttctaagggggactctgtcccccttagataccgaaaaagttccatagaaactttttcggataaccccctcacctttgcacggcaaaggtggttcgggacacgcgtcccgaagtatagggaacaaagtccggcaaagctggactttgttgaagtattgtaacggcgcattgcgatgcgccgagggggacagcgtccctcttagaacaaggtttgtctgccgccgaagtgcggcggggtcgtcaggacagagcgcaccgcatgcctcggcgtcccattttcacaccgcactccggaagcaatataaaaggcaatcccgcacaattaaagctgcggcgctttacggaaattttgcgtcctgatgttgttgtgattttttgcaatacactcgtattgctgcaaaaccacgcctaatcagtacgcaaaatttactcgtaaatcgctcttgtttaattatgcggtattgcctaattcagaaggagtatcagcaagccatgagaaattatgcaacgcagatggatgccgcaaagcgcggtatcgtcacgccggagatcgagacggtcgcaaaaaaagaaaaccgtccggtcgagttcatcatggaacgagtcgcaaagggtacgattgcgattccggcgaacatcaatcacaaaagcctgtccgcagaggcggtcggcgacggcacccgcgtaaagatcaatgtcaatctcggcatttcgggtgactgcaaggactacgagatggagttgcgcaaggtgcgcatggccgttgacatgggcgcggagtccatcatggatctatccaactacggcaagaccaacaccttccgcaagcagctgatcgacatgtcgccggcgatgatcggcaccgtgccgatgtacgacgcgatcgggtatctggaaaaggacctgctcgagatcacagcgcaggatttcctcaaggtcgttgaggcgcacgccagggagggcgtggacttcatgaccattcatgcgggtatcaaccgccgtgcggttgaagccttcatgcgcgagggccgcaaaatgaacatcgtctcccgcggtggctcgctgctgtttgcgtggatgaagatgactggcaatgagaatccgttcttcgagtattacgacgaggtgctggacattctgcgccgctacgacgttaccatttcgctgggcgacgcactgcgcccgggctgcattgatgatgcgtccgatgcagggcagatcagtgagctgatcgagctgggcaaccttgcacagcgtgcgtgggcgaaggacgtgcaggttatgatcgaaggtcccggccatatggcgatgaacgagatcgcggccaatatgcagatggaaaagcgcctttgccatggagcgcctttctatgtcctcgggccgctcgtcaccgatattgcaccgggttacgaccatattacctcggccatcggcggcgctattgccgcacaggcgggcgcgaacttcctgtgctacgttacaccggcggagcacctgcgtctgccggatgaaaatgacgtccgcgagggcatcgttgccagcaaaattgcggcccacgccgccgatatcgcactcggtctgcccggtgcgcgtgaccgcgataatgaaatggcggacgcgcgtcataagctggactggcccgcgcagttcgcgctggcactcgacccggaaaaggcagagcggttctataatcaggttccgccgaccgagcgtcatacctgctcgatgtgcggtaaaatgtgcgccgtgcgcaccacaaatatgatccttgagggcaaagaagtcaaattctgctcggaaaagggcgcatgctgatgcttcggaatacaaaagagcggtcgggagaccgctctttttttgctgtttgtttgaattgggcgtgtgcagaatggagaattgaaaatggagaatggaaaatgaatgcgatggcagagtgctgcgtgggcggccaatggccgcccctacggttaaacgtttgcaaatcgttagaaacggtgcgctgaggtcataccccggggcaccttctctggcccttcgggcaattcaccttctgttgcacctgcgcaacactcgtcagtgcacgacaaaattctacaaacaaaaccggcacataaggagagaaacctctgtatgtgccggttttcgcttgcagctaagaaaaatactggtgtctcagctccagattgtacgcaagcagcgtccgcagccgctttttgccgcgagaacagtgccgcgataccgccgatggactgatcccaagccgttcagcgcactgtttgcaggataatccctccacctcgatcatccacagcacctcgtactgccgcggtgtcagctgctcgcgcatggcccggaagaaggccgtgcggaatgcctgccggaagccgcggtcgtcctccgcgagcagaccgagatactgccggtaggccagccgtgtcgctgtgtgctcagacagcgcgacagtccgcatgcgcatcaccttcttcactgtggtcgtggtagtgctccatcaggaatacggtctggcggctttcgttgatcagcgtctgcaggaatttcgcgcgctgcttgagccggtagcgcacctccggctgacgcgcgcgcttctgcgccgcctgaagctgcttgatacgcagctccagcagagcgacatttacacggtattcctgcgccatctcacataatttcatggcggcccctccttacgatatacgaacaaatgttcgattctttatgtcccttataatacaacataaagtatgagttgtcaatgaaaaactatattttgtgtgatattcctcaaatctgcatcatacactgtggtagagagggaaggaggagataccatgcgcagactgctgctgaccggtgtcggactggtgctggtgctgtatttgctgccggtattttacccatcggaaacggacaagacggagccgcaggcacccacagaaagcgtcacagcggcagcaacagacggcttaaccatcacggttctggtgaacggcaaggcgcaggaaatgccgctggagacctatgtggaaggcgtgacggcggcagagattgcggacgattttccggttgaagccatccgtgcacaggcggtcgcagcgcggacgtacgcggtgtataagcagtcgagaggacggccggcagagcatccggatgcggatgtctgcgacgattacagccattgtgcggcatatcagccggacgcggtcaagacgttcagcaccggctattcgcggatacgcaaggccgtcaaggacacggcagggcagatcctgacctgcgacggtgcaccgattgcggccgtgttccactgcgtcagcggtccgaagaccgagtctgccgccgatgtctggggcgaggatattccgtatctgcaaagcgtggtcagtccgggcggcacgcagtacgccggatacgagagcgaggtgacgctaacggcggatgcgttccgcgaaaaggtcgcgcagactctgccaaaagcggatgtgagcggtacgcccgaccgctggtttgcgtcctcggtgcgctcggcggctggcggtgtgaaaaccgtgaagctcggcggcgtgaccgtcgagggaaccgcagtgcgggcgctgttcggcctgcagtccacgaatttcaccatcacaaccaccgaggacagtattacgtttcacaccatcggatacggacacggtgttggtctgtcgcagtacggtgcgaaatatatggcggagcagggatatgattataccgagatacttgcgcattactacccgaatacagagttgagattggagagtggagagtgaagagaatggaaaatgggaagattgcgaactatgttcgcatataaaatggagcgcgtagcgcgacaaaaaagtcaggacatgtgcctgacttttttaacaaacagagaaatcctccgaaaaccgggaagttttcgggggatttctctgcaatagcccttacaggcttgcctggcaagggcgtttctcgatagaaaggacggttgcgtcctttctatcgaaggcgaagccttagaatgcgaaattcgtttttacgcgccagatattctgtgcatactcagcaatcgagcggtccgctgcgaagcggccggagtttgcaatgttgatcagcgccatgcggttccactgatcctgatcgcggtaaacctcgcttacgcgctcctgagcggctgcgtaggatgcgaagtccttgaggctcatatagcggtcagccgggccgccgttgccgccgtgcagcagcaggttggcaatatcggtgtagtccacgccgtcaccgaagccgtggatcatctgatcgagcacgcggcggatcaccggatcgttctgatagatgaccatcggctcatagctgccggaagcggccagtgcctcagcctcgggcgtctccataccgaagatgaagatgttctccttgccgactgcctcgcagatctcaacgtttgcgccgtccatcgtgccgatggtcagagcaccgttcatcatgaacttcatgttgccggtaccggatgcttccttgccggcgatggagatctgctcggaaacctcggcggccggcatgataatctcagccagagataccttgtaatcctcgaggaatacgaccttcagcttgtcgcgtactgccggatcgttgtcgatcatcttggagatggagttgatcagctggatggtctttttcgctactgcgtagcccggtgcggccttggagccgaagataaaggtgcgcggaacgaaatccatatccggattgtccttcagcttgtgatacaggctgatgatgtgcagaatgttgagcatctggcgcttgtactcgtgcagacgcttaacctgtacgtcaaagatggagtccatgttgacttcgatgccgttgtgcgctttgatataatccgccagacgctgcttgttgtggcgcttgatctcgcccagcttgtcgagcagctccttgtcgtctgcatagttgttcagaacctgcagctcggacggatgggtgcggtagccggtgccgatcttgctctcgatgagctctgccagctccgggttggcctcgcacagccagcggcggtgtgcaatgccgttggtgacgttgcagaacttggaggagtagatcttgtagaaatcggtgaatacgcgctccttgaggatctcggagtgcagcgcggatacgccgttgatggagaacgagcctgcgatagccagatgcgccatgcggacggtatcgtcggcaacgatagccagcttggagatcttctggaagtcgttcgggaagtagttccacagctccttgcagaagcgctcgttgatttcgtagatgatctgcataacacgcggcatcagctcctgaacgagcgataccggccagcactcgagagcctcaggcataacggtgtggttggtgtaagcaacagactggctggtgatgttccaggcctgctcccagctcatgtcgttctcgtccatcaggatgcgcatcagctccggaataaccagagtcgggtgcgtatcgttgatgtgcaggacgtgcttgtgcgcgaagttttcaagcgtgccgtacttggccttgtgctttgcacagatgtcctgcagagttgcggaaaccaggaaatactgctgcttgagacgcagggactgaccctcgcggtggttatcctccggataaaggaccatggagatggtctctgccagtgcgtgcttctccagtgccttcagatactcaccggaggagaacagtttcatgtccagtgcgatcgggctctgtgccttccacaggcgcagacgcgcgatgttgttggtgccgtagccggagatcggcatatcatacggaactgccagaaccggcgtgtaatcgtggtagttgacgaccagcttgccgttatcgtcgaagtaggtgtcaaccgtgccgccgatcttgacctcgcgggtctcatccattgccggaatctgccaaacctcgccggtagacagccaggaatccggcagctcgacctgctggccttctacgatcttctgcttgaaaatgccgtgctcgtagcggatggagtagccggtgccgcgtacgccgtcggtcgccatgccgtccatgtagcaggccgccagacggccaagaccgccgttgcccagaccgggatcagcttcctcctcgaagatgtccgccatctcgaagcccatgtccttcagggctgcggtcagagcgtccagcataccgaggttgtaggcgttgttgcgcaggctgcggccgacaagaaattccatgcacagataatgcacctgacgctctccgtcgcgctctacctcattctgggtttcgatcatgtgctcggtcagtgcatcgcgcactacgagggcacaagcctcgtatacctgatccttggtagcgtcctctacctcgcaggcaaaatgtcgctgcagtttacctgcaatggcttctttcaaagcggtctttgtgtactgggtctttggcatggtctttcttatctcctcacataattttggtaggcagtcccacgcggttgcatcggcggtgcttgtcggaaattttgtgccctgatttcgttgcggctttttgcaatacacaaagtattgctgcaaacccgcgcctcgtcaggacgcaaaatttgctcgacaatccctcgctgctgaaccacgcgggactgccttggaaataccgcagattttactgggtaaaaataatacggtattaccgggtaccgtcaccgtattccctcaaatcgggtgacgggtcgggctgacaggtcggttactgacccatcgcggtcttgtaaacctcgatatatttatcggcagagctaccccagctgaagtcgctctgcataccctgcataatcagcttgctccacgcaggcttgttaaagcggaatacgccgcaggcctcgcggataacgtgcagcatgtcgtgcgcgttgtagcttgcaaaggtgaagccgttgcccgtgccggcataatcgacaaaggcgtgaacggtgtccttgaggccgccggtctcgcggacgatcggaatagtgccgtagcgcagtgcgatcatctgtgccaggccgcacggctcaaacttggacggcatcaggaacatatcggcgcctgcataaatgcggtttgccagatcgccggagaacatgatggacgcggaaaccttatccggccagcggcgctttgcctcgatgaacatctgctcatagcggtagtcgccggtgccgagcacgatcaggcgaacatcatccgccagaatatccggcaggactgcttccacaaggtcgagtcccttctggtcaacaaagcgggtaacgatgccgatgacaggcgtgtttgcatcgccctcaaggccgcagagcttcaaaagctcggtcttgttgaccagcttatcctgcggattgttcgggccgtagttcttgaagatcttgctgtcggtctccggattgaacgcatccatattgatgccgttcaggatgccgtgcagcttgtagctgttcatgcgcagcacggaatccagacggtagccgtagtattcggtctgaatttcgttggcataggtcggtgaaaccgtggtgacagccgtggaagctacgatagcagccttcatcaggttgacgtcgccgtccatcgccataaagccggagcggaagtgtgcatcgtcaatgccgagcacatactccagaatctcacggccgtagcggccctggtactggatgttgtggatagtgaacacggtcttgatgttctcgtagaacggacgggaagcgaacatcaggttgtagtaaaccggaacgagggcggtctgccagtcgttgcagttgatcacatccggcttccactccagatcgggcagtacctcgagtaccgccttggagtagtacgcgaagcgctctgcgtcgtcgtactcgccgtagatctggccgcgtgcgaagtaatactcattatcgatgaaataataggtaacgccgtctgcctcatagcggaagataccgcagtactggttgcgccagcccagacggacgtaagcgtttttgatgtaatagaacttttcgcgcatactctggtcgatcgcagaatacagcgggcagaatacacgcacgtcatgtcccttggcagcgagtgcctgcgggagcgaacctgctacatcgcccaatccgccggttttgatgaacggagcgcattcgctggtaacatacatgattttcataaagccgagcctccccaacagagagtgcggaaacagcgctgaccgtttccgcacccgttgtaattttattatactcgtttctgtctgaatgtaatatagcaatatttcacgaacatttgcgctgcggaaaatgcgtttttgctgtgatagcaacttctaaacagaagtttatgcggatttaacagaaaaggatcaaacggttgcgtttttggcgatggtgatcggataattttcgtgtcccatcatcgtgcggccatcacggataataacattgcggtcggtgatgacatgacggagcgaagcctcggtcagaatgcgtccgccttccatgatgatgcagttattgacctcggcgcccttttcaatcacaacgtcgcggaacaggacggagttctttaccttgccttcgatgcggcagccgtcggcgatgaggcagtcctctacgtcggcttcatcgccgtaataggtcggagcctcgtccttgatgcgggtcaggatcggacgggtgcgcttgaatacctcgttgcggacatccttgtcgagcatgtccatgttggagcggtagtagtcgaaggtgtcctcgatcttgacggcgtactcgttgaacaggtagccggctaccgtgccgtccatcagggcacgggtgagaaactcgcgctcaaagtggatgcagttatgggttacgcagtcggacagcatgtggataaggtactggcggctcatgacgtaaatgccgagtgccgcatgcttgcacttgccctcgttgcagtctccaacgcggatgtcaacggcttccttcttgcggttcagctccacataggtggtgaacggggaattcttctgcttcttggtgcataccatggtcaggtctgcgccggacttgatatggcggtcgatcacgtcgtcgagcggtacattggcaacaatgtcgccgtccgctacgactacatagtctgcacggttcttctgcaggaagtcaaccgcaccggccagtgcgtcaatcttgccgcggtactcgccggttaccagcggagacgccttcttggagtaggagtacggcggcagcaaggttacgccgctgttcttgcgggaaagatcccagtccttggcattgccgatgtggtcgatcagggactggtacttgtccttcatcagtacacccacgcggtaaatgccgctgtttaccatattggaaagcataaagtcgataatgcgataccggccgccccactgtaccgcaccgaccgtgcggtgctcggtgatctcgcggagatcgttgtcggtatcaaatgcaatgatcatgcctaaaacgctgttcatgtttgtgccgcccccttactttacgtccggcagatcctcgtctgccatttccttagcggccagctttgcgccgctgccgatgcgaacgccttcggctactaccgcaacgccccagttgtctacgtcgctgtcggacgggctgccgccgacttccgcgcccttggcgataacggccttttcggctacgatggagtagcgcacggtcgcgccttcctcaaccacggcacccggcatcaggatggaatattccaccttggcacccttgccgatcttaacatccgagaacaggacggactcggaaacgtcgccgtagatctcacagccctcggagagcagggtatgggtaaccttagcctgcttggaggtgaaatgcggaggcgaaccggtggtgcggccgtagatcttccagctgtcatcggaaagctgcaggccggagttcggagagagcagatccatgtttgcttcccacaggctctcgatggtgcctacgtccttccagtagcccttgaagcggtaggaaaccagcttttcaccgttattcagcatcgccggaataatgtccttgccgaagtcgttggaggactgctcgttggcctcgtcattgatgaggtattccttcagctttttccaggtgaaaatgtagatgcccatggaagccagcgtggacttcggctccttcggcttctcctcgaattcgtagatggtgccgtccggcttgcagttcatgatgccgaaacgggaagcctcggaaagcggaacgtccagcaccgcgatggtcgcgtcagcgccggtctccttgtgctgctggagcatcttgttgtagtccatcttgtagatgtggtcgcccgaaagaatgaggacatactcgggatcgtaatcctccaggaactgaatgttctggtagatggcgtttgcggtgcccttgtaccactcggtctttttgctctcgtacggcggcagaacatagacgccgccgcgcaggcggtcgaggtcccacgtctggccggaaccgatgtaagcgttgagcacatgcggctcgtactgggtcagtacgccgacagtatcaatgccggagttgacgcagttggaaagcgggaagtcgataatacggtacttaccgccgaacggtacggcaggcttagcgacctttttggtcagcacatacaaacggctgccgcggccgcctgcgagcagcatggctacgcattcttttttccgatacatgtaaattctcctttttcacagtttgcatcgctgcgatctatacgccgtctggcgtatcccctctgtgtatctctctttgcggatttgcgtctgtttcaggcgttaatctgctttattaggcaataccgcataattgaacaagagcgatttacgagtaaattttgcgtactgatcaggcgcggttctgcagcaatactgtcgtattgcaagaaaacgcaacgacatcagaacataaaatttccgtaaagcgccgcaattttaattgtgcggtgttgccttttaaccgccggttgcggttactgccttgtctgtcggtacggaaaccgctttttcagtggctttcgcaactgccttggttccggtgcgtgccaccgctttttcggtggttttcgcaactgccttggttccggtgcgtgccaccgccttttcagtggtctttgcaacggatttggagccggtcttggctacggccttctcggttgtgcgggcaacggccttggtgccggatttcgcaactgccttggtcgagcgggtgcgctttaccggtttcttggcagccgcggcttttgcggcctcgatctctgccttggtgcggcgcttggctcttgccttgcctttgaagaacagcacgccgaagcgcggaatcttcagaacaatggactgttcctgaccgtgcatgggcttgttttcggtcttgagcttgccgtttgccatgccgctgccgccgaactcggtcttgtccgaggtgaatatctcttcataagtgccggtgatcggaacgccgatgcggtattcctgctgctcctccggagagaagttgacaacgaccacgatatccgagccgtccttcgccacacggcggaaggcgatgatgttgttgcggttgtcctcatggctgatccattcaaagccgcgccagtcggtatcctgctcccacagctgcggagtagcaaggtagaagtgattgagcgccttgacgtacgcctgcatctggcggtgcgccggataatccagcagcatccagtccagtccgcgctggtacgcccattcggagaattgtgcaaactcgccgcccatgaacagcatcttcttgcccgggtgtgcggccatgtagccgtacagcgcgcgcagaccgccgaactgattctcgtacggaggcggcatcttgctgatgagcgagcacttgccgtgcacgacctcatcgtgcgagagcggcagaatgtagttttcggaaaaggcgtacatgaacgagaaggtgatcttgtcgtgcatgtccttgcggaagaacgggtcggccgagcagtagcacagcatgtcgttcatccagcccatgttccacttgaagttgaagcccagaccgccgtcgtaacccggcttggtcaccatcggccatgcggtggactcctcggcgatcatcataacgtccggatgatcggtcaggatgtactcgttgagcagccgcaggaagtcaacggcctcgaggttctcacggccgccgtggacattcggccgccattcgccctgccggttgtagtccagatacagcatggaagcgactgcgtccacacgcaggccgtccatgtggaatttctcgatccagaacatcgcggaggagaacagcaggtttctcgtggagaccttgccgtagtcgaatacgcgcgtgccccattccttgtgctccatcttgagcggatcggcgtattcgtacaggtgcgagccgtcaaactcgaccagtccgcagccgtccttcgggaagtgcgccggaacccagtccatgataacgcccagaccggcctgatgcgccttgtcgatcaggtacatcagatcctttggcgtgccatagcggcttgtggcggcaaagtagccgattacctgatagccccacgagccgtcgaacggatactcggtcagcggcataaactcgatgtgggtgtagcccatttccttgacatacggcacaagctcgtccgccagctggcggtaggagtagaagttgccgtcctcgtgcatcttccacgagccgaggtggcattcgtagatgttgaccggattggaatacggcaggtgctttttacgccaatccagccacgaggcgtcgccccattcgtagccgtcgatgtcatacgccttggtggcgttgcccggacgggtctcgaaatggaagccgtacgggtcggacttgtcaaacacatcgccggacttggcccatacactatacttgtatgcggcatattccggaatattcggaataaatttctcccagataccctgttcatcgcgcgtcatataatcggcgtcgcgattccagtcgttgaactcacccatgacggaaactttttcggcctccggtgcataaacacggaacagataaccctgttcaccatcctgcacgaaagggtgggctcccatgtaatcgaacgcgcgacaatcccggccggaatagaaaagctcgcttcgcttttccacggcgggtgctgcggattttttcttcatacagcatctctccctttacagccgccaaatgaaggaaaatacgaatattttccaacagtttgtgtacttcgacagaattttggcggaataccctcactttagttagatatagtatacatcacataaatagaaaagtccagcaatttagcacaattactggactttctttacagaaattttgtttgctttccacatcatttgagtgggaatgacaaaataacgtacaattcgatataaatttgtttagaaaatgtgacggcggatgagatcaagcgccgtagaagcggcctgcatgcgtacacggtcgcggccgagcgaggactgcattttacgggtaaagaacttgccgtcgtaccaaacgctgatatagaccagaccggtcggcttgtcctcggtgccgccgcccgggccggcaatgccggtgatgccgacgccgatgtccgagccaagcgcatttgcaacgccgacagccatctgctctgcggtttcgggagataccgcgccgaccgtatcgagggtctccttcttcacgccgagcaccttctccttgacactgttgctgtacgagcatacaccgccgaggtagtaatcggatgcgcccgggatgtcggtcagacgcttggacagcagaccgccggtgcagctttcggctactgcgagggtcagcttgcgctcgcgcaggccgtcgccgactacctgctcgagcgagtcaacgtctacgccgtagacgtcgtcgccgagcagctcgaggatttcgtcaacgaccgggtcgagcatcttctcgcattctgctggggtgtccgccttggcggtaacgcgcgcgaagcactccgaggtgcgggcatacggcgcaatcgtcgggtttgcgcttttttccatcatgtcgtgcaggatattctccatgttgctctcgccgaggccgaatacgcggatgttgcgggatacgatgcagccgcctgccagcttgtacagatacggcattgcacattccttccacatcgggttgcactcgcgcggagggccgggcagcatgagaacgtgcttgccgtcggcttcaaatgcacagccgggcgcagtgccccagagattggtgaacaccgtgcagccctcgggcagccatgcctgcttttcgttgttcttggtcatttcgcggccgatggtcttgaaaaagtcggtcagacggtccatcgacggctgatgcagctccatcttcttgccgaaaacggtcgcgagtgtttccttggtcaggtcgtcgagggttgggccgaggccgccggtggtgatgatgatgtcggcgcggtcctttgcctcgcggactacgcgctcgagacgcgccggattgtcaccgacaacggtctggtagaatacattgatgcccagctcggacagaccctgcgagatcagctgtgcatcggtgtttacgatgtcgcccagcaggatctctgtgccgactgcgataagttctgcgttcaatgaaagttcctccttaaatcaagggaattgctattttaattactaattcctcattcctaattattacggaaggtggataatctccacacccttaaccgcctcgtccacgagtgcttcaacgtcgaggtggctctctgcctcgaggatcttcggcatcttcggcttggtattcgggtgcttcggggtgaatacggtgcagcagtcctcgtaggggaggatagaggtctcaaaggtatcgatcttacgggcgatcgtgacaatttcctccttatccatgccgatgcagggacggaataccggcaggtcgcacaccgcgccggtaacggccatggcgggcatggtctggctggcaacctgaccgagcgactcaccggtgatgagcgcaccgcagccgtactcaacagctacgcgctcggcaatgcgcatcataaagcgacgcatgatgagcgtgaacagctcctcatggcacttgtcgcggatttcctcctgaatgtgggtgaacggcacgaccatgacgctcatgcggccgcaccatgcggtcagcttgcggcccagttcaagcaccttctccttggcgcgctcggacgtatacggatagctgaaaaagtggatgccgcacagctccagaccgcgcttggccatcatccagccggcaacaggggagtcgatgccgccggagagcagcagcgctgcacggccgttcgagccgatcggcatgccgcccgcacccggaaccggaccggcgtgaacgaaggcgtacttctcgcgcatctcaacgtgtacggtcaagtcgggatggtgcatgtccggacgaacatcaggaaacagatcagcaagctcgccgccgacgtgctggctgatttcggtggaggtcatcgggaatttcttgtcgccgcgcttggactcgaccttaaaggtcttagccgccgcaaaattgggtgccagatagtcctttgcggtcgcaatgacactctcaagcgtcttttccgggcagaccgctgcacgggagatggtcgcaaagccgaacacacggcttgcgcactccataaccgcatctgcgtccgcatcgtccggaatctccacataaacgaccgactggcgcatggtgatctcgcagtcggcaacgtgcgccatgcggcgcttgaggtttttcagcagacgatcctcaaaggttttgcggttgagtcccttgaggacgatctcaccgcacttgagcagtaatacttctttcatttattgtctccttgatggtaaatttatttgtttgcgctgatgatttccttctcctcggcggtcatcaggctgtcgcggtcggcgctgtccgagccgaactccaagcgggtcttgacgtaatcatcatccggcaggttgaacacctgtgccagatagtttaagtaaacgtccgccatgatttccagcttgccgtaatcggtttcccacggtacgagcgactgcgtgccgacgctgaccgtgccgtcctcccggcggtcaattttgaccggcagactgcattcctccgcacgcttttcggcggtgttcggcaggctgtcgtaaaggccctccatccagaagcggcatttgccgtcatatacggcgagcttctgctccgagccgtccggtttggtgatgattttgtattccatatagattaaactccttgtttttcctgtacttcgatctgtccgcgtgccgcagagacgatcacgcagtatttttcgctgtccttgtatgcgcggaagccgtaatacccgagcgggtctttctcctcgggcatggtgcagccgatgccggtgtcatcaggaagggtagtccaaaatgtgccgctaaactctattttgaagcggtatagatcggtgtagcctgcttgtttgaccagcttttccgcattggatgcgctgattggacgaacagccagcagaaagacccccatcgtaaccagcatggtcaccataaccgtaacaggtacggcaggaacggttttcagatgcagcttagagatgagagcaataaccacaatacaggtcagtgcaaaccagtattcaaagtggtacggttcggtgatgagaataaccggtatgctgactgcaatcgtacaccataagagctgatacagccgtatccgcagaaaggctgtcgggtagttccattgcgttgtataggtctggtcgtcaatgttggaacgaagtgcaaatacgatacataccgcacatatggaaccggtaaagaacggctcctgcagcagcattccatcatatacggcaaagtgcagatagaagattatcgctgtacatatcagacaaatcaatgtgtttataaccacttttctcataaccctacctcctcgcaataattcctaattacgaattagcttatctgcggaacattttcgcgccctttttaaccgccgccacaaaggcatccacatcttcctttgtgttgaacggtgcgaacgaaacgcgcagcgcgctgtccgtgcgcgccttcggcagaccgagtgccttgagcacaccgctctgcttgcccttggagcaggctgagccgctggaaatgtaaacctcgtccccctcgagtacatgcagcatgacctcgctcttgcagccgggcatggaaagattgacaacatgcgggatatcgccttcgccgttaattacagcatccggcagctcggcgctgacctgctgcttgaggtagtcggccagctcctgcacatgggcgtaatcctcgtcgaaatgcgccatgcgaatctcgcacgccttggcaaatgcggcaatattcggcacggcctcggtgcccgggcgcatgccgcgctcctgaccgccgccgaacgtcagcggaggcaggcgcaggccctttttcacatacagcgcaccgatgcccttgggtgcgccgattttgtggccggaaacgctcatcaggtcgcagttccattttttcggcgtcaggcgtacacggcaaagaccctgtacggcatcaatatggaacagcgccttgggtaccttggccttgagcagctttccgagctgttcgaccggctgtactgtgccgatctcgttgttgaccagctggcaggagagaagaatggtgtcctcggtcagtgcttcgctcagcacctcgggcgtgatgtgaccggttgcgtccggtgcaaggaaaactacgtcgaagccgtccgcagcaagctgctttgcggtgttgacggttgccgcgtgctcgatctcggtcgtgatgatgcggccctttttatgtcggttgaggtgagcggcaccgcgcaggctgatgttggtgctctccgtgccgcaggcggtgaaatatacttcctcgggcagacagccgagcgcagacgcgaccgtcctgcggctgtcctcgagcagatgcgaggcctccagacccatgcggtgcaggctggacggattgccgaactcctcgcacatcgcgtgaacggccgcttcggctgcttcgggcagcacgcgggtcgtcgccgcgttatcaagataatgcatagaaaaacgaactccttcatcgggacagaccgccgtgcggccatacttcccgctattataaaatattttacaacggcgggccgtcttttacaagacaaaaacgtgcaaaacggcattgaaaagtagagaagggtatgctataatttcaagggtatgatccatacatatataaagtatatcgcgtgacaagagcacgttgcagatagaaagggaggaaatcctatgccaggtaaggtaattctcggcgctcagtggggcgacgaaggcaagggtaagtttattgatattttcgcaggcaaggcggatctggttgtccgcagccagggcggcaacaatgccggtcacaccgttgtagccggcggtgagaagtacaagctgcagctgattccgtccggcatcctgtatccggagtgcgtcaacgtcatcggcccgggtgttgttgtcaatccgaaggctgtcctcggcgagatcgatggtctgcacgagaagggcgtttccaccgacaagctgttcatcgacgcacgctgccactgcatcatgccgtggcaccttgagctggatgcgctcagcgaggcagagaaggccaaggaaggcaccgcaatcggcaccaccaagaagggcatcggcccgacctatatggacaagtccgagcgcagcggcatccgcatgcacgattttgtagacgcagagcgtttcgaggaggttatccgcgagacctgtgcccgtaagaaccgcgtgattaccggcgtttacggcggcgagccgatcgacgcggacgctgttatcgcagagtacaaggtttacgcagaccgtctgcgtccgatggtgcgcgacaccaccgttatgacctatgacgccatcaagtccggcaaggaagtgctgttcgagggtgcgcagggcacactgctcgacctcgacatgggcacctatccgtatgttacctcgtctcatccggtagcaggcggctgctgcatcggttctggtgtcggcccgactgccatcaacgagatcatgggtatctttaagtcctacactacccgtgtaggcgagggtccgttcccgaccgagctgttcgacgagaccggcgactacatccgcaatgcaggcggcgagttcggtaccgttaccggccgtccgcgccgtaccggctggttcgacgcagtcgttgcacgctatgcggttcgtgtaaacggtctgaccgacgttgtcatcaacaagatcgacccgctgcgcggcctgccgaagctcaaggtctgcgttgcatacaagctgaagaacggcgagactgttaccgagttcccggcaaacttcatggatctggtagactgtgagccggtttacgaggagttcgacggctttactgaggatatcacgaactgccgttccttcgaggagctgccggcaaccgtacagtcctacatcaaggagctggagcgcatcatcgagtgcccgattaccatgcttggcgtaggccctgctcgtgatcaggttatgaccatcaaataattcgtccgaaaccacgctttcggacgagagggacgtaccgagccaatggctcggatacgtcctatacgggattttgcgcgtccgccttggcgggcacacaaaatcccttttttcttgtaaaaaacgcaggcgctatccttgcgcggctatgtccgcgctgcgcgcgcatgtcctgcgtttttttgcatttgcacggcaaacgcgattgaatgccgccgtgaaacggcggtcgtgcacggcacgggacaatgactcggatttctgaacgaaatcctgtcatgtagttgcggtttgcaagcaaaccggaattttatatgtgctttcgcacgaaaaaaggacgcatattatgcgtcctttttggaacggattaaatagctgcgttcattctccattgtcaattctcaattcggcaatcagtcgcccatcgacagtccgagcgctcttgcctgcttcaccagttcgccatcgggcggaacggttttcagcttgcctgcgacctcggtcagcggaaccggcacgatctggttatcctgcagcgcaaccatatagccgaactttttctgcaggataagctgggctgccgctacgccgaaccggcttgtcagcacacggtcggccgggcagggagcgccgccgcgctggtaatggcccggaatggtaacgcggatctcctgaccggtcagctccttcagctcgtccgcaatgcggtaggagatggacggataggtcatcgcctcgcgggcagccttgaattccttcttgctcagcttggcctcgtcctgacttatcgcgccctcagccactgcaatgatcgagaatcgtttgcccgctttggcacgcttttcaatcgctgcggcaatcttttttgcggagtagggaatttccggaataacgatgacatccgcgccggaggcaatgcctgcgtacagcgtcagccagccggctttatgtcccatcacctccacgatgaacacgcgcgagtgcgaaaatgcggtggaatggatggaatcaataaccgtggacgcgatatcaattgcggactgaaaaccgaatgtcagctcggtgccccacagatcgttgtcgatcgtcttgggcagcgttaccacgtttacacccttcatgctcagcaagtttgcggtcttgtgcgtgccgttgccgcccagaatgaccagacagtcaaagtctgcctttttcaccgtgtgcagcattttatccagcttggtctcctcgctgtcctcgatggtcttgcgcatttccttgaacggctggcgcgacgtaccgagaatggtgccgccgaccgtcagaatatccgaaaaatcctcgggcagcatttcgtggtaatcgccctcgatcaaaccgcggtagccgtcccgaataccatagatggttactttatctcccagttcgttatacagtgttttcgctacaccgcgcagtgccgcgttcagaccctgacagtcgccgccgctggtcagcataccaatctttaacatactcgtctgcctcctgactctgtttttcacattctgtatattgtacaatgcgcagtatcgtatttttactataccctatttggtgtaaattgaaaagatactttacacagattccaccgttttttcacatggattttttgtgactttcggcagttgcatattgagcggcagatgtgttatgctaatgccagacagattccctgcaactgacggacacaggtggagcgcaaaccaccggggagcagggagttccgtaatcagatgcaccgtgaagtgtatcttaatgccgaccgtctgggcagtgtcgcaagtaatacgcgatgctgtccttttttgttaccataaaaaaggacagcagacagcacaaacaggaggaaaagaacatgaacgcatggaacaactttaatggcggcaactgggaaaacgagatcaatgtccgcgactttatccagaagaattacaccccgtatgatggtgacggcgcttttctggctccggctaccgcacgcacgactgcgctgcgtgagaagttcgacgcattgctcgcggaggagcgcgaaaagggcggtgtccgtaatatcgacaccgagaccgttatcactatcacggccttcggtccgggctatctcgacaaggacaacgaggttatcgtcggcctgcagaccgatgagccgcttaagcgtgcatgcaatccgttcggcggcatgcgtatggtccgtgatgcgtgcaagcagtacggctatgaggtttctcccaagattgaggaggagttcaagtaccacaagacccacaacgacggcgtattctccgcatacaccaaggacgttcgtgaagcgcgtcacgttggtctgctgaccggcctgccggatgcttacggccgcggccgcatcatcggtgactaccgccgcgtggcgctgtacggcgtgaaccgcctcatcgaggagaagcagaaggacaaggatgcgctcggcagcgtgccgaccaccgagaaggaaatccgctgcgcggaggagctgagcgaccagatcaaggcgctcaaggacatgatcgcaatggcggcttcctacggctttgatatcacccgtccggcggagaacgcaaaggaggccgttcagtggctgtactttggctatctggccggcatcaaggagcagaacggcgctgcaatgagccttggccgcacctccaccttcctcgatatctactttgagcgcgatattgcggcaggcctgctcaccgagagcgaggcacaggagatcatggacgatttcgtgctgcacctgcgtatggcgcgccacctgcgcacgccggagtacaacgagctgttcggcggcgacccgatgtggatcaccgaggcagtcggcggcatcggcgaggacggccgtcacatggttacgaagaacagctaccgcatgctcaacaccctgtacaacctgaacgctgccgcagagcccaatctgaccgttctgtggagcgaaaaactgccggagaactggaagaagttcatcgcaaaggtgtctatcgacacggatgccctgcagtacgagaacgatgacgttatgcgcccgtactacggcgatgattacgcaatcgcgtgctgcgtatccgcgatgcgcgtcggtaaggacatgcagttcttcggtgcgcgtgccaacatcgcaaagctgatgatgatggcgatcaacggcggccgtgacgagaacaagttcgagcaggtcggcccggagatgccggtcatggacggcgatgtgctggattatgaggaggttctccgccgcatggacttctaccgtccgtggctggctaagacctacgtttccgcgatgaacaccatccattacatgcacgacaagtacgcctacgagaagagccagatggcgctgcatgataccgaggtgcgccgcctgatggcattcggcattgcgggcatgagctgcatggcggattcgctctccgcgatcaagtatgccaaggtaaagcccatccgcaatccggagaacggcattatcgttgatttcgagatcgagggcgatttcccgaagttcggcaatgatgatgaccgcgtagatcagatcgcgtgtgagcaggtcgagaagttctatcaggcgctgacgcagttcccgctgtaccgcggtgcgatccacacgctgtccatcctgaccatcacctctaacgttatgtacggcaaaaagaccggcaacacgccggacggccgccgtcacggcgaaccgctggcaccgggcgcaaacccgatgagcggccgcgacgtttccggtgcgctggcttccctcaactcggttgcaaagctgagctatacctactgccgcgatggtatctccaacacgttctccatcacgccgggtgcgctcggcaagaccgatgaggagcaggtgaacaatctggttgccatcatgggcggatacttcgcgcagaacgcgcatcacctgaacgtaaatgtgctcaaccgcgaaactctgatggcggcttacgagcatccggagcagtacccgaacctgaccatccgtgtttccggctacgcggtgaacttctacaagctgagccgcgagcagcagcgtgaggttatttcgcgtaccttccacgaggcgatctgagttttcgcttgtgaagcgaacagaactgcgctgacgccgcgtgggcgcacaagagggatggacaccaaggtttccaccctctgattttctccccgtttcctttgggatagtctggcgcagattgccgacatgtgaccgttctgaaaagggaacggcagaggattttttcttccgcagagacggcctgcgaccgctcatgtatccgcatattcgcagtatcagataccgtactgctacacaggtggttttctttccgcagggtgcggcatgacagtgccgcacaactctttgcccccagcggtgggtaccgcacgttccccgtttacccaaacggattgataaattcagcaatgaaaggaaagtggcaatatgaccggaaacattcattccatccaatctctcggcgcggtggacggccccggcgtgcgatacgtcgtatttatgcagggctgcccgctgcggtgcgtctattgccataatcccgatacctggctgaccgaaggcggcacaccgaccgacgtggacgagttggtccgaaagactctccggtttcgtccgtactggaaaaacggcggcggcgtaaccgtcaccggcggcgaaccgcttctgcaggccgaattcgttgaggaattcttcgccaaactgcatgagcacggcgtacacaccgcgctcgatacctccggcgtgggcaatctctccaaagcggaaaaggtgctcgcgcacacggatttggttctgtgcgacctgaaattcctcaccaaagcggattatctcaagaactgccgcgcggatttcgaccagattgagcgtttcctgcagctgaccgcgatgaaaaacgtgccgctgtggattcggcatgtggttgtgcccggtctgaccgatgggatggaccatttacaccgcgtcaaagccaaggcggaaagctatcccaactttgaaaagctggagtttttgccgttccacaagctgtgcatggaaaaatatgaacggctcggtctggagtttccgctgaaggacacgcctgccatgaacccggatgccctgaaaaccatggtcgcacagctgtaacacggtaaaacgggaatcaagcggcaaattatgaactttaggcaacaccgcgtcttgtcagtacgcaaaatttactcgcaaattactcttgttcaattatgcggtgttgccttagaaacaaacctttcaaattctgttcaaaattcgttcacacattttgcggcaaagtgcggtatactaacattgtcgatgagggaagccgcaatcccgaacgacacagcctactgattttttttatttctcttttaccccctttattttgtgaaatgaccgaaaacaccctgtttccgttccccctcggaggcagggtgttttcctgtacgaaaccgggttttcggcagtacacaaacctttcaaattctgttcaaaattcgttcacacattttgaagcaaagtgcggtatactaacattgtcgataagggaagccgcaatcctgaatcgatagtcatctacaatcttttatttctcttttaccccctttattttgtgaaatgatcgaaaatgcctcggttccgtttcccccacggagccggggtgttttcctgcctcggagtatctttgaaatggttaagcaggatacttgtttacattgtaaaaaatatttcaaggtctgttcatgatttgttcacaattaaagggcgcctgcgcgatatactataggtgtcagtaagagttaccccttttctcaagctgacaacctcttttctttgattttatcaccttttcttaaactcttttcatttgcatcaacgagaacgccctgtttccttcccccgggaaacagggcgtttctcttttggctgccaaactgcggtttggacgatatgctgttttcttttcatatccttcacagcatattcaaatttcgttcacacattcggcataaaaagacggtatactgtacttgtcagtgagggagagccgcaaatcccgcattgacgtcatccgattttttttcatttctctttttcccttttttcaatttgtgttattaaccgaaagcaccgctgtttcgttcccccacgaaacagcggtgcttttctgtttttggcatttgtcaataaataagccggtgctatgcttgcggaaaacgtttttttagggtatactgttttttaggcaagatatataggtaaggagttgttttttatgggttgctcgcataattgcgatagctgctcgtctaactgcggcggcgaaaagagcctcaaggttgcagccaatccggcggcctctgttaaaaaagtcatcggcgttgtttccggcaagggcggcgtaggcaagagcctgctcacctcgatgatggcggtcggcatgacgcgcaagggttattcctgcggtgtgctggatgccgacatcaccggcccgtccatccccaagaccttcggcgtacacggtcagctcgagggctgcgaggaaggcattcttccggcacgtagtgaaggcggcgtacagatgatctcgatcaatctggtgctgccgcatgaggacgatccggttatttaccgcggtccgatcatcgcggagaccgtcaagcagttctggtctgacgttgtatgggacgacgtagacttcctgtttgtcgatatgcctcccggaacgggcgatgtaccgctgaccgtgttccagtccctgccggtggacggtatcatcgttgtcacctcgccgcaggatctggtctccatgatcgtaggcaaggcggttaagatggcgaagatgatgaacattccggtgctcggcattgtggagaactacagctatctggcgtgcccggactgcggcaagcatatttcggtgttcggtgagagccatatcgacgaggtagccgcacactacgagctgccggttctggcaaaactgccgatcgacccgaagctggctgcggcggttgacgcaggcaagatcgaggatgcaaagctgccggacgagctttccggtgcgcttaagaccgtggagggtctgttatgaacattggcgtagcatatgaaaacggccggatcgccaagaatctgggcgactgccgtgaggtgctcattatcaccaccgagggccgggaaccggtcggcaagcgcattgccgggattgccggcacatccgcgaccgacctgatcaagttcgccggtctggagcagatcgacgtgctcatctgcggttcgctcggtctggcaacgcgcaacgcactcgagatgctcggcgtgctgctcgtgcccggctgcgaaggctcggcggaggaatcggttgcaaagttcctcgtcggtgaaaagcagggtgacccgaccatcctcgagatcggccgtgaggaagatccggatgatccgatggcatgcatgcacgactgtgcaaagtgctccggctgcggcccgagcgagctgctcaagcagattccggtcgaggagatcaagtaaaaaacataaaaaccaccgattttcggtggtttttatgtttccaatggagaattgaagatggagaatgaatgttcagatgaagcgagtgccgctccttttgcggaaaggtaattctccattttccattctccattctcaatttgatgaaactgtgttataatcaaatgtatcattataatataaggaaagaagctattatggataccgaaaatccgaaaacggcaatcgaatacatacactctctcggcagattttccggcaagccgggtctgcaccgcatcaaggcgctgtgcgaggcgctgggcaacccgcaggacaggctgaagtttgttcatcttgcgggcacgaacggcaagggctcgaccgcgtgcatgatcgcctcggcactgcaggcggccggactgcgcaccggattgtatacctcgccgtatctggtgcagttttacgagcgcatccgcgtggacggtgtgatgatctcggacgacgatctgacgcgcctgtgcgaacgggtaacggtggcgtgtgaatcgctcacactgcccgagggtgagaccatcggcgagtttgagtttacgaccgcactggcgttcctctgctttgttgagcaggaatgcgacattgtggttctcgaaaccggtctgggcggccgctgtgatgcgacaaatgtcatcaaaaatgcggaggtctgcgttattacgccgatttcgctcgaccatatggcggtgctgggcaacacaacggcggtcattgcggccgagaaggcaggtattttcaagccgggtacggcggttgtctgcgcggacggtcagccgaacgatgtacagcgggtgctgcgccgtgcctgcgacgcggcgggcgctgtctggttcggcggagcggaggactgccgcgtactgcggtgtgacatcggcggttcggcgttcgtgtacgaggcgcagggctacaccattgccatgcccggacggcatcagctgcagaatgcgcggacggctctgcgggcgctgaacgcactgcgcgagcgcggctggaacattccgaccgaagccgccgtgcgcggtctggcgcgggcgcgtatcgcaggccggctggaacgcgtggtcgatcagcctctcatcctgctcgacggcgcacacaatgccgcaggcgcggatgccctgtgtcacgcggtggatgagctgctcaagatgaagcggctgcacgttgtgatgggcatggtgcgcgacaaggactacgaaacctgtgttcacgaggtcgccagccgcgcggatgacttttacgcctgtgtgccggatgcgggtgagcgttcgctggatgtacacacgattgcagagctggcgcggcagtcgtgcaagcgcgtatacgaatgcgaatccgccgagcacgccatcgagcttgcactggagcatgcgaagatgaacgactgcattcttatctgcggttcgctgtacctcatcggtgagtgcgagaagattttgcgcggccgaccgaaagcgacagattaaaatgaaataaacaggtaaaataaggcttgtactttgaaagtacaagccttttatttttgtgtcagttgttttaaataggtatattgtttggtatatcgcagggcggggtgccctgcgaaataagaggtaatattttgctgatttcgaggtgacatatatgctgcaaatcacgcagagaaggcaggagggcacgctgatcgcggtgtacaccggtgagctggaccatcatgcagcacgggcggcgattgagcagaccgaggatctgctggtgctgtttccgtgtgaaaagctggtgctcgacctgtccgagctgacgtttatggacagctccggtctggcggtcgtcctgcacctgtaccgcacctgtgcccgcagcggacgcgaatttgcggtgcgcggcacgccgccgcagccgatgcgggtgtttgaggcggccggtctgccgcaggtgatggtttttgaaagggggaaggaataatgcgggcggtcatcaacaaaatgagcctgaaattcgagagccattcggtcaacgaggcgtttgcgcggcaggcggtcggcgcatttgttgcgcagctggacccaacgatggaggagcttggcgacatcaaaaccgtggtctccgaggcggtgacaaacgccattgtgcacggttacgcggacaaatgcgggtttatcacggtcacggtgcggctgttcgagggacgcgctctggaactgaaagtaaaggacgccggatgcggcattgagaatgtcgagcaggcgcgccagcccatgttcaccacgggcgacgacacgcgcagcggcatgggatttactatcatggagacattcacggacaaaatgcgcgtgcgctccacgccggggaagggaacgctggttgcgatggtcaaggtgctgaaggagaggcaggcgtgaccaaagaaatgcgcacgctgctcgagcaggcggcttcgggcgacagggatgcggaagcgcggctgatcgaggacaacagcggtttaatctggtcgatcgtgcggcggtattacgggcgcggcaccgagccggacgatctgtatcagctggcgtgtgtcggcttcatcaaggccgtgcgcggtttcgatgtgtcgctcggcaacgagttttctacctatgcggtgcccaaaatcgcgggtgagattcggcggtttctgcgggacgacggtgcggtcaaggtcagccgggcggtcaaggaacgcgcggttcgtgtgcgccgcctgcaaagcgactgggagagccggaacggacggtcaccgactgtatcagaactggcacaggccgccggattgacggtcgaggaagtagcggcctgcgagcaggcggacgtatcggtggactcgttcgagcgggagctgtccggcggcggacgcgtaggtgatctggtcggtgacgagggaatggaggagagaacctgcctgcatctgtcgctgcacgaggcactgcaggacttgcccgagcgcgacaggcaggtgctcagtctgcgctattcgcgtgatttgacgcagcagcaggtcagccgcattgtcggcgtgtcgcaggtgcaggtttcgcgcatcgaaaaacgcgccatagagaagctgagggaaatgctgagagagtgaaaaaggagttgagactgtcgaaaaacttcgtttttccgacaatctgtgttttgacttcgcaaaacacggacgtccgaaagttcccgtgcggaaactttctccctctgaaagtatgaaaaccgaggtacacgcccccggttttcatgcatttgggctgcaaatgctatttcatacgcgctgccgcgcgacagcatcagcatcgcgaaaacgaacttaattgacagcctaaaaaggagttctcgtgagagaactcctttttatttgtgcggtgacagaagaatttgtcccatcatcacacaaatttcaaccagatatgcagtataaagcgcaagtatcactctgccaagccgcaattcagctgcaatcgagcagtacagcagaaacggaaagctgacgagtatcagcagcacgatcagcgccgcaatctgaaatttactgcgcggcagccgccccgatcggaatacaatcataccgataagaaaaataacggtaaataccgcaaacagaatcgtgagctggcggcggcctgcatgcagcgcgtctgcactgacatccggtggaacatcggataaaatacccgtgagataccacagcgggagcgcacatatcacgaaaaacgtgagcgcgagatggcgcagcgccaagcagaattcctgtcgtttgctcataatttatgcataaactgtccggccgacttggccatcagccgcttggtgcccttctgatcaaacgcaatttcgagcagggcatcgccgcccatcggctttaccgacacgatcaatccatcgccgaaggccttatggaacacgcggtcgcctgcggcaaaattcggcagcggcttgcttttagctgccgaggccagcgacgcgctcggcgcagtatttgcagcggaaacgtaccgcgcgcgagccacctgcggacgcgaaagcgtcggatcaggtgcagtcgcgttcgagaaccggcggctttcggtgatattgctctcaagcagctcttccggcatctcatcaacaaagcgcgacggatgcgaatactgcgtgcggccgtacagcaggcggcgctcggcgcaggtgagatacagctgctccttcgcgcgggtgacggcaacgtagcacaggcggcgttcctcctccatgtcctcgtccttctccattgcacggaagccggggaacagcccgtcttccatgcccgcgaggaacacgaccggaaattccagacccttggcggcatgcatggtcatcatgataaccgcgtcatcgtcctcgccggactggtcggcatccgtgtacagcgccatgttctcgagaaaatcaccgagcgacggcgtttcggtcttgtcctcgtaatcgacaatgtaggattttaactcctcgatgtgctcaatgcggctttcctcttctgcgccgccctttagctgcagcgcacggatgtagccgcttttgtccatgagttcgtcgtacagctcggaaagcgagacaaattcccgcagcttgcgcagattttcgatcatctcaccgaacttctccattgccacggcaccgcgggacagggcagggtactgagaggcatggcataccacatcatacagcgttgtgccgtactcgacggcaagctgcatggcggtttcgaccgatttatcgccaatcttgcgggcaggcgtgttgatgatacggcgcagacgcagctcgtccgcaggattttcgatcacccacaggtaggcgaacatgtccttgacctcggcgcgcgagaagaaatcgcggcccttgtacacgcggtacggaatgcccgcgcggatgaaagcggcggcaatgttgtctgaaagcacgttgttgcggtatagaacggcaaaatctccccatttccggccctgctccacgccttcgcggatggtgtccgcaatgtaggcagcttcgccctcctggctgtccgagcggtgcagacgaatctttgcaccgtcaccgtggtcggtccacagttccttgcccttgcggccgacgttgttgcgaatgacctcgtttgcggcattcagaatgttgccggtcgagcggtaattctgttccagacggatggttttcgcgtccttaaactgcttttcaaactccagaatgttcgtgatcgttgcaccgcggaacttgtagatactctggtcgtcatcaccgaccacgcagatgttctcataataacctgccagcaggctggtgagcacatactgcgcgtagttggtatcctgatactcgtccacgagaacatagcggaactggcgctgatagtattccagcacctcggggttgttctgcagcagcagcacggttttcatgataatgtcgtcgaaatccagcgcacaggcctttttcatggccttttcgtaatcgcggtagacgtctgcgaccttttcacgaaagtagtcaccggcggcatccgcactgaactgacgcggggtcatcagcttgtccttcgcgcgggagatcatgcccatcacggttcgcggatcaaaattcttgggatcgagatcgagttttttcattacgttgagaatgacgcgcttcttgtcgtcctcatcgtagatggtgaacgcgctctcaaagccgagcagatcaacgtgcttgcgcagaatgcgcaggcaggctgtgtggaaggtgtatgcccagacagcggacgcggcttcctcgtcaccgagggcaaattccagacgctcacgcagctcacgcgcggccttattcgtgaacgtgatcgcaatcacctgccacgggcgggcgggattcatcgcgcacaggtgctccgcgcgggcacggttctccggtttaggatcggtcaggtattcggtcaggaacagaagatcgtcctcggtcgcccagtcgggcgcatagggattgtccagtccatcgccgaacttgagaatgttgatgatgcggttgatgagcacggtcgtcttgccgctgcctgcacccgccaggatgagcagcggaccctcggtctgatagacagcctcgcgctgcttgtcgtttaatttggaaaagcgctgttcgatgatcgcacgccggacagcggcatatttcatatcaaatttggtcggttccataggtttcctcgtttcgtttgaagatacagaaaatcaaatgcagagatagtatatcatattcgggaaaagaaaacaaatgttctatccggattgcgtaaaaaagtcgatcggagtatactataaaaagaggtgagcacaatgacagacaaacagcggcaggaaacctatgcgcagatgctcgtgcggctttcgcgctcgaatttccgcagccgctttcatttgaaggcgcaggacaagcagtacatccgcgagaaaggatggaatacaatcgccgaccatgcggcagacttcgtctccaagcggcttgcaccggccgaaccgaaaaacgacggcaagcagacacccatgcgcgggcatccggtgttcattgcgcagcacgcgaccgcctgctgttgccggggctgtctggagaagtggcacggcattccgcagggcgtgccgctttcggcggagctgcaggtctatatcgttggaatgctgatgagctggatgaggagagaaatggaaaattgagaatggagaatggaaaattagcgtgaagagaacgtaatgttttacccttcttcatgtcattatatttcatcataaatgtaaaccgtagggtgcgacgactcggcgcaccatttgtaaaccatctgcacatgcttaatcgtaggggcgcacagtgtgcgcccgcagcgcgactggagtctgcgcaagaaacgttcaagaaccgtttgatttgacgttgcgcgggagcacaatgtgctcccctacggggtaacgtgtatcaatcgttagatacggtgcgccgaggtcgtcgcaccctacggtaaagtttattgataattgtagcctgcaggtgccgtccgcagccacctaccaacgagttgcgcgacactgttatgtcgcgcctgcgtagatgaacccgcctgtgtagcagaacgaaatctgacactgcgtagagatagagaaatgggcgcacattgtgcgctcctacggtagaaagaatcctctgccgttctccttttcgaagcggtcgccggtctctggtctgcgccggattcggaaacaaagggaaacgggagttaagagggtagaaaccgcaggtgtctgccctcttgcccgccgccgcgggtgcggtgaaccgcccagtcgtccggacggcgcccgttccatatccgatagtgaacaacttgatgaggatttgtatagctgcaataatcttcatgataaaaatctgcatttcgtacaatcaatctcttgtaacaaacgacacgatttgataatatataaagtgtattgctgttttgcttgccaaatgacaaaacagcataattgattctctgccgggcggcagggataaggaggaaattgaggtttcatgagtaaggttgagcagtatatcaccagcattccggattttccgaaggaaggcatcatcttccgcgatattaccaccgtgctcggtgacgcggacggcttccatctggcggtggacgagatgactgcgctgctggacggcgtagagtttgacgcgatcgctggtctggaatcccgcggattcctgttcggtgcaccgatggcgtataatctgcataaggcattcattccgatccgcaagcagggcaagctgccgcgtgcaacgtcccgcatatcctacgagctggagtacggcatggagaccatcgaggtacaccgcgatgacatcaagccggggatgaagatcgtcgttgtcgatgacctgatcgctaccggtggtacgcttgaggcggctgtccacctgttggagcagctcggcgcaaaggtcgtcaaggttgtctgcctgctggagcttaagggtctgcacggacgcgaccgcatcaaaacctgtccggcggagacggttgtcgcttacgaggggaagtaagcaagggcaataccgcataattgaacaagagtgatttgcaagtaaattttgcggtgttgcccaagacatttcacagtaatcaaggcgaaagcctgaaaattaaaaagggggttattcgatgtttgaacgtgttttcaagctatcggaacacaaaaccacagtcaagaccgaggtcatggccggtatcactacctttatgaccatggcgtacatccttgccgtaaacccgagcgtactcggctccaccggcatggataccaccgcggtattgctggcaaccgccctggcatcctgcctgggcacgctgtgcatggcgtttatggcaaacctgccgttcgcgctctctgccggcatgggtctgaacgccttcatggcgtacaccgttgttgcaggctatggctacagctggcaggttgcgctgctggccgtattcattgagggcctgctcttcatcgtcctgtcgctgaccaatgtgcgtgaggccatcttcaatgccattccgctgacgctcaaaaagggtgtttcggttggtatcggtctgttcattgccttcatcggtctgcagaactccggtctgtgcgtagactccgctacgttggtcggcatcatcagcttcccggagaatttccacaccgcaggcatctgcgcactgctgacgctgatcggcctgttcttcaccgcagtattctatacccgcaagatgaagggcgccatcctgtacggcattctgctgacctggatcctcggtatgctctgccaggtgaccggtctttacgttccgacgccggacgcaggcttctattccctgttcccgagctggggcatgaccgacttctccaagctgggtctgaccttcggccagtgcttcaacgtggatttcagcgcagtcggcatcgtaaacttcatcgttgtcatcttctcgttcctgttcgttgatattttcgatactctgggcacgctgatcggtgttgccaccaaggcgaagatgctcgataaggacggcaagctgccgggcatcaagcccgctctgctggcagactcgattgcaacctccgcaggtgcaattctgggtacttccaccaccaccacctttgttgagtccgcatccggcgttgcagtcggcggccgtaccggcctgaccgctctggttaccggcatcctgttccttgtatccacgctgtttgcgccgatcttcactgccatcccgtccttcgcaaccgctccggcgctgatcatggtcggcttcctgatggtaggcactgtaaccgagatcaacttcgatctggacaacctgaccgagtccatcccggcttatctcgccatcatcgctatgccgctgttctacagcatctccgagggtatctctctgggcgttatctcctacgttctgctgaatgttgcagccggcaagggcaagaaggttgctccgctgatgtacgttctggcagtactgttcgtactcaagtatatcttcctctaattaagaaatcgtaaagattgcagaaggctgccgaagctcgcttcggcagcctttttttgtggcatgaaaatcatggtaaatatcagagaaaataagcgaaaacagcggagattgcagttgaacggtgtcgatacttgacagaaaacgtaggagttggtaaaatataaaacgactaaatttgggcagtatacccgtttatcttgtatccaaagggaaggaggcagcgaatatgacacagcagcgcaaaaagtgcggaaaaggcggctttactcttgtagagctggtggttacgctggtcattctgagcattctgtttgccatcgctgtaccgagccttctggggtatatccatctgtcgcagttccgaaagaatgaatcgtacgctaagaccatgtatctgtcggcagaatctgagctgacctaccttcgtaccggcggtgaatgggagtcattctgcagcaaggtgaagaaggaaggcgtgctgaatcagtcgtttgatgagtcggatgaggaccggaaaaagctggtcggtcgtatttacggcattcgtctggatgcaggcgaatacgcagaaggtgagctgtcgggtgacggtgcgctcgtcggtgcgctgctttcgcaggatacctacgataaaagtgtgctgaatgctgcaatctgcatcgaaatcgacgtggaaagcggtcaggtttattcggttttctacggcacaaactgcaagggactgtactacggatcgaatgaggacagcaaaccggcggatatgtccggcagctggctggatattgattacagcaagcgcgaccgcgatacgcgccagaaagaacagctgggctattactcggttcaggatgcagtcaatgctgtcagtctggatgcgaccaagctgaagatcacctcgatcaatctggtaaatggtgaaaccctgtcgctgaactggtcgagcaatgtgaaggatcaggatctggataaggtttattacgaggtcaagctgtacagcagtgaggataaagcgcagctcctgtcgatcaatattccgggcaggaatttgaaaacgggttcgcagtcggttgcggttacgaccgaggacaacgcgacgaaggattataccttccccgtggaatacgaccgttccaacaagcgggcaacacttgtgctggacggtatgatgaatgcgaagctgtacgaccggctggataagctgtccgctgataacaaagcagccttccggcagagcagcgataccagcatcacgcgcttcggcggcaaactggaaaaaccgctgaatgtttacgcagccgtgcaggtatttccggacccgaatgcagaaaacaccggcggtgaggagtatcaaaagagtgacgctatcgaatccaataaggcgaacacgcttttcggtgacggcacccggtcggataacagccggtacgagatcgaaaccttccgtcatctgtccaatatccgttatatggatacggaggcggcatttgccgttaccgcacgttcgctggactggacgagcgacagtgtaaaggtttacggtacggcagcccgcggcgcgcttttggtctccgccggcaaggatatcggcttcccgagtatccctgcgctgcgcagcaatcagacactggacggcacaggcggtcttctgaaccgcattgccggcgtgtttaccggcgggaatgtcatcagtaatctcaagctggatgagacctcgattgccgatgacgcagagtatcttggtctgttccggaaaaacgcaggcacgatctataatctgcgtctgctcaatccgcaggtggagattgcctcgggtaagctcaagggtgtcggcgcagtctgtggttacagcaatggttctttgaagggcgataacgtggacggcacccaagccagggtggaggctgcgctgacttcggcacaggcgcagggcgctgtaacccagtggctgaactttctcgatgaggtggagcacaggtacaagggtctgcgtgtgaccaatttcagtattgcagactatgattatgtggcaaacaacacgcaggcggtcagcaccaatctgatcaccggcacgctggagatctacatgtgtgtcagcgacaaggaggcagacgcatgaaaaccaatttgcgtatcggcgaagtgctgatggagcgcaattatatcacgcaggagcagatggagcaggcgcttgcctaccagaaggagcaccgtgaaaagcgagtcggtcagatcctgatcgagctgggctttgtcaccgaggcgcaggtgctcgaggcactggctgcccgtctgggactggagatcgtgagcatcggacagatgcaggtcgatctgaccgctgtccgcatgattccgcgcgagctggcggaaaagcagaacctgcttgcggtcggctttgcggacaagagcctcgaggtcgtgacgaacgatccgctcaactactttgcctttgaggaagtgcgccagctgaccggctgtcaggtggtcatccgcctgagcgaaatgggtccgctgcagagcgcaatccgctactattacgccgaggtcggtgcacagcaggcggcacagaacgccaacgaggactttgcagagcgcaatgtggagatgttgcaggtcgaagagagcgaaagcggcgatccggaagcgccgatcgtcaagctgctcaacagcctgcttgaccgtgccatcagcaccggcgcgagcgacgtgcatatcgagccgtttgagggcagtacgcgcgtgcgcatgcgtatcgacggcacgatcgttgattatgtaacgctgcagcgcagtgtgcaccagccgctgatcgcgcgaatcaagatcatggcgaacctcgatattgccgagcgccgtctgccgcaggacggtcatttccgtatccgtgtgggacagagcgagtacgtcaacatccgtgtatcgctgctgacgaccgtgttcggagaaaaggccgtgctgcgaattctggcaacggcgggtcaggtcgatcacgccagccacttcggcatggatgacgaaagctatgcaaggttcctgcctatgctgaactcaccgaacggcattatttatatcaccggtcctaccggctcgggtaagtccaccacactgtacatggtgctcgagtacctgtcgcaccggcaggtgaatatctccacggttgaggatccggtggagaagaacgtgccgagcatcaaccagacgcaggtcaatccggttgccggactgacgtttgagtccggtctgcgcgcgctgctgcgtcaggatccggatatcatcatggtcggtgagacccgtgacggcgaaactgccggtatttcggttcgtgcggccatcaccggtcatctggtgctgagtacgctgcataccaacgatgcggtctcgagcatcgtccgtctggccgatatgggcatcgaccactatctgatcgcaaattcgctggtcggtctggtcgcgcagcgactgatgcgcaaggtgtgtccgcactgcggcagagaggtcgcagttacgccgcaggagcaggcgctgctcggcaaggatatcacgaccatcaagcgcggcacaggctgtacgcactgcaacggcaccggctaccgtggccgtattgccgtgcatgagatcgtcacgatcgaccgcaatatccgccgcatgatcagccgcggcgccgaaaccgaggagatcgaggcctacgcgcgggaacagcagggcatgcgcagcctgaaggaaaagggtctggaactggtaaaacagggtgttactacaccggaggagctgctcaggatcgcgtattacgcataatcggaaaccgctctgtatcttttgatacagagcggttttaacgattataagcagaattacagaacgaaatccacataaatgaacgtgcgttcactgttgattggctccccggagccgaaaacttttcctttacattcttatctcaagcgggtataatacccattgatggatggcattccgcagagcggaagctataccttgtcacaacatgtttttcaaatttttccgacagtgattttacgttgcgtcataccacagaaagcgggtgacagcatgaacattggcattgttggagcaggaaaagtcggcttttccttcggcagactgcttgccgaaaaaggcgtgcggatatccggctattacagccgcaattccgacagcgcaagagaagccgcagaatttacaaattccggacactataccgacctgggcaaactcatcgaagatagtgacgcgatttttatcaccgttccggataatgcgatcaccgaggtgtatcggcaggtcgcagaatttgaaattcaggacaagtatatatgtcattgcagcggcgcctgcacagccgaggaagcctttccgggtattcacgcgcagggagcctatgcaatatccattcatctgctatttccgatcagcagcaagtataactgctggcgggagctggcaggtgcttttttttgcgtcgagggtgacgcgcaggcggtcgaggtctttgtaccgctgctgcgcggactggggctgcaggtgcagaccatttcgccggagagcaaggcgcagtaccacctcagctgtgcactggcaagcaactttgtctgcgcacttgtgcagcgcagcgccgagctgctgggcggctgcggattctcggaggaggatgcgctgcgggcgctcacgccgctcatgcggagcaatctggcgcatgtgatcgagcacggtgccgtctcagcgctgaccggacccattgagcgcggcgacacgcagaccgtgcaaaagcatctgtcgtgcctgacggaacgagacgaccggcagctttacgcgctgctgggactcgaacaggtcaaaatggcacaggaaaaacatcctgagcaggattacggcacgcttgccgccctgctgaatagggaaaaggagcagaacgaatgaagaacacagtgagcacatttctctcgatgaagcaaaacggcgaacgcctcaccgagatcaccagctacgattacacgaccgcaaagctggtggaaaaggcgggcatcaacgccattctggtgggcgattcgctcggcatgacgatgatgggctacgacaccacgctgccggtgacgatggaggacatgatacaccacagcgcgtgcgtagtccgcgcgtgcgagaacaccatggtcatcatggatatgccgtttatgagctatcaggcgtcggtttccgaagccgtgcgcaacgcaggccggctgatgaaggaggcgcgcggtcatgcggtcaagctggagggcggcgcagccgttgccgagcagattcgcgccattacggattctggcattccggtgcaggcacatatcggcatgacgccgcagagcgtcaacgtgttcggcggctttaaggtacagggcaagggcgaggaggcggcaaagcggctgctcgaggatgccttcaccgtacaggaggccggtgcattttcggtcgtgctcgagtgcgtaccgcccaagctggcggcgctcatctcgaaaaagctgaccatcccgaccatcggcatcggcgcgggcgcaggctgtgacggacaggtgctggtctatcaggacatgctcggcatgaacatggacttcacgcccaagttcgccaagcagttcgacaatatcggtgagcgcatggtggatgcgttccgcacttacatgaacgaggtgcagaacggcacgttcccgaccgaaaagcagagctttgtcaagtctgactgcagcgatgaatatctcgccaaactcgacgctgaattttgagagaaacaggagcatatacaatgaaaatcgcaacaaccatcgcagaagtacgcgcacaggtgcgcgagtggaaacagcagggtctgaccgtcggtctggtgccgaccatgggctatctgcatgaaggacacgccagtctggtcaaaacgtccgtgcagcagtgcgaccgcacggtagcgtccgtgttcctcaatccgacccagttcggtccgggtgaggatctggagacctatccgcgtgatttcgagcacgactgtgcgctgctgaccgagtgcggctgtgacatggtgttccatcccgaggtgtccgagatgtatccggacggctttgccacctttgttgaggtgcagtccgaaatgccgcgtcagctgtgcggcaagacccgtccgattcatttccgcggcgtgtgcacggtcgtttccaagctgttcaacatcgtaacgccggataaggcgttcttcggccagaaggacgcacagcagctggcgatcatccgccgcatggtgctcgacctgtccatgggcattgagatcgtcggctgcccgatcatccgtgaggcagacggtctggcgaagtcctcgcgcaatacctatctgagcgcagaggagcgcaaggcggcgctcgtgctgtcgcgcgctgtaaagctcggccaggagctggtccggaacggcgagaaaaacgcggatgcaatcgtcaatgccatgcgtgcgcttatcgagcaggagccgctcgcgcgtattgattacgtctccgcagtggacggtctgaccatgctgccggtacatgagatcaacggcggcgaactgatcgctatggcggtctatatcggcaaaacgcgcctgatcgacaacttttcggtggagggctaagtcatgacagtacagatgctcaagggtaaaatccaccgtgcaacggtcaagcaggccgagctgaactacgtcggctcgatcacggttgatgccgatctgctggacgcggcaggcatttatgaatacgagaaggttgccatcgtggatattgagaacggcagccgctttgagacctataccatcgccggtgagcgcggcagcggcatgatctgcctgaacggcgcggcggcgcgctgtgtcagcgtgggcgataaggtcatcctgatggcgtatgcgcagctgacgccggaggaggtcaagtccggctatgctccgcaggtcgtgttcgtggatgaggaaaataagatcgtccgcaccaccacctatgagaagcatggtctgctcaaggatatggcgtaatgaaaaaggagaacccgggtgggttctcctttttcattagtgcagagctgagaattagagtgaagagaggtaaggtgaaacgcaggcacaagaaaatattcgcaggtgccgtctatcacagcgacactgttgcgtcgcgcctgcggagagtaaaccgtatatgtagcagcagggtaggcgagaactgcgtagaggtagagaaatgggcgcacactgtgcgcccctgcggaagaaaaaatcctttgccgtttctcttttcgaagcggtcgccggtctctggtctgtgccagactatcaaataaaaggaaactggagtcccaagaggatagtactcatctaatccacgcacggcgtgggaacaaggtttagtggcctacgggcaaaccttggtgtctatccttttgtaaccccagctaagggttagcacccattccttatgtgtaagtaagcagattaaccctgaaccgactccatctccgtcgcagaggacttgtctgcgttctcccggaacagcagaccgaaaatacggcgtaccagcggaccggctgcaaagaactgccacagcagtgccatcgggaagttcataacggtggtctgtacccagattgcaaagaactgtgcgttatggctgtccttgaacagcagggtggcaaagaagctcatgcacgggcacatcagccatacggatgcagccgagatggcaagcataatgctggtctggctggcttcgcgcgggttgacaagacggaatgcaaccttcatcgccagcttgccgacaaacaccagctcgagcagaattgcgataacagtcatgatcggccactcgtggaacactgcgagaaatacccagttctgcatggaaccggtgttcagcacgatgttgtacgctaccatgccgtataccatgacagaagccatgataatggtgtaaataacgtcctgaaatttgttttttggcattttgttttctcctttttgtatatgtgaaatattttttgataacgaatagaaatgcagctgaacgcaaaaaaataggacgaagtaaactttcgtctacttcgtcctatggactacttcaactaccattaattataaatatcataccatattttataggcgttcgtcaagactaactttgttattgacaagactgttccctgggtgtatactgtgtctgtaaatgagaaccccctcccttgggggaggggtgtagataggagatgcgatatgaaacaacggtttcgggtgggcggcatgagctgcgcggcctgctccgcccatgtggagaaaagcgtttcggcggtgccgggtgtcagcggcgtgcaggtaaatcttctcgccggcagcatggcggtcgagtacgacgaaaacgcgtgcgacgcacagacgattataaaggcggtcgagtccggcggctacacggctgcggtggatgacggcaggcagacatcggctccggcgcaaagcccgcaggcggacgaggcgctgaaggaaatgaagacccgtattatcgtttcggcgattttcatgcttgtcctgatgtacttctcgatgggcgagatggtcgggctgccgctgccgtcctatgcggcaggcatggacggcatgttcaatctggcgctcacggagctgatcctcacgctgccgatcgtcattatcaatcgcaaatattatatcaacggcttcaaaacgctgctgcaccgtgccccgacgatggacgcgctcattgccgtcggctcgggtgcggcgcttgtgtacggcatttacgcgctgattcaaatcgcgctcgcgcccacgcctgaggcagcccacagcttcatgcacgacctgtattttgaatccgcaggcatgattttgacgctggtaacgctcggcaagttctttgaagcgcgtgccaagcgcaagaccggcgaagcaatcgcagcgctgatggacctgcgtccgcagaccgccgaggtcattcgtggcggtcagaccatgcagttgccgattgagcaggtacaggttggcgacctcgttatcgtgcgcggcggtcagtccgtgccggttgacggcgagattaccgagggcagcgcctatctggacgaaagcgccatcaccggcgagagtatgccggtcgaaaagcatgttggtgataccgtaatcggtgctaccgtgtccaagagcggctatgttgttatgaaggcattgcgtgtcggcgacgatacgaccctgagccagattatccgtctggtagaggaggcaggcgcgtccaaggcgccaatcgccaagctggcggataaggtggcaggcgtgttcgtgccggtcgttatgggtattgcgctcgtgacagcaatcatctggctgctggtcggtgaaacgccgagttttgcgctgacccgtgcgatctcagtgctcgttatctcgtgcccgtgcgcactgggactggctacgccggtcgctatcatggtaggcacaggtgtcggtgcgaaaaacggcgtgctgttccagtcggcggaggcgctcgagaatctgcacaacgtaaacgcggtcatcatggacaagaccggtaccgtaaccgaaggccgtccggtcgtaaccgacgtaaaatccttcggcgtggagtcggctgacctgctctcgctggcactgtcactcgagagccgcagtgaccatccgctggcggacgccatcgtgcgctatgcacgcgagaagaacgcgcaggagcgttcggtcaccgactttgagatgatagagggacaggggattcgcgcaactgtggacggcgtgccgtgctttgcgggcaaccgccgcatgctgctcgctaacggactggcgctgtccggctcgatgcagaagctgggtgacgagttcgccgcagcaggcaaaacgccgctgttctttgcggcaaaccgccagattgtcggtatttttgcggtcgctgatgtgctcaagccgaccagtaaggcggcagtcgaagcactgcgcagtatgcacattgacgtaacgctgctcaccggcgacaaccagaaaaccgcgcagtccatcgcgtccgagctgggtgtgaccgatgtgatcgctgaggtgctcccgcaggacaaggagcgtatcgtgcgcgagaagcagggcaagggccgcaaggttgccatgattggcgacggcatcaacgatgcaccggcgcttgcgcgtgccgatgtcggcattgcgattggcgcgggcacggatgttgcgatttcgtctgcggacgttgtgctcatgaagagcgatttgatggatgcggtggatgccatccgcctgtcgcgtcagaccatgcgtaatatccgccagaacctgttctgggcgttcttctacaactgcatcggcattccgattgcggcgggtctgctgtgggtgccgttcggcatcaagctcagtccgatgattggcgcggcggcaatgagcctgtcgtccgtctgcgtggtatcgaatgcactgcgcctgcgctttttcagcgcaacaccgagaaaaacggcggggacgcctgctgttttgcccgtcagcggcgaaaagccgcttacggcacataaaaaggaggaaaatgttatggaaaagacgatcaaggttgagggcatgatgtgtcagcactgcgtggcacatgtcaaaaaggcgctcgagggtgcagcagccggctgtaatgttacggtcgatctggatgcaggcaaggcagtcgtttcgggcaaaacgctgccggaggatgctgttctgaccgcagccgtcaccgaggcgggctataaggtggttgacatcaaatgatggcagatcgtaaaaaggtcgagccgctgcttaggaccgcgcgcgggcagattgacggcgtgctcaaaatgatcgaggacaaccgctactgcatggatattatgatgcagctgcaggcggttgaatcgctggtgcataaggcgcagagagaggttcttcgcggacacctttccggctgcgtgcaggatgcgtttgagaccggagatcagaacgaacgcgagcagaagattgcagaaatcatcaagctgctggataaagcgtaagcggaaggacgtgccaaaaggcacgtccttcttttaccttaaaattgaaaatttgtgtagtttcatacagttcgcacaaaaatcacaaatgaattttgtgcgaaaatatggaaaataaaaggaaacatttctgctgaactatgatataatttatgtgtagcagaaattacctgctgcgcggatgaaccaatcagattccatgtgcccggaacaaccggttcattcagcttagacaacttgatctgtgcatcatgcgccaagggcgtgtctgtacagaaaaaggcacagccggtgaaagccggtgtcgcaaagccatgggtctacccggagtaattactccgtaggacagccggttgccgaacagcagaattcacgcctcctttgcgtctgtatgcacgcagaggaggttttttgcatgaaaaagagaaataaccgttttcttgccggtaccctcgccggattgatgatgctgaccatgctgcctgttaccgcgcttgcggcgcaggaaggtgcggacggcgatgctgcatccgacacctcgaataatattgtaaacgtggtaagcgacggtaaaaacgttcagcaggctgagaataacaatgtaaatgttgaggaaaacggcggcatcgagaatgcacagaaatccgctgacgatagcaacggtgacaccgagaatgtacaggaatccgctgacgacagcagcggcgacagtgccgatacagccgcagctaatcagcaggagggcgaaaacagcggctcgggcagcagcggtgagtcagctccgactccgcctccgactccggcggaagagccgtttgttgcgaagattggtactcagacgtataaaactctggaagaagctatcagcgttgcgaagaacggcgatacgattgaagttggtcaggatattaccattgaagaaggcggtcttgccttcgtagaaaaagatgctctgacaattaagggtgttggagactccaagccgacgattacaatgaaagatcttggtatgtcgctttccaagacgaaagtaacatttgaaaacatcaagattgttgaagagtctgttacgaacaatccggctgacagcggtggtacggctaatcttgtcagcaattccaatttcacgcttaaaaatgcttcgcttgaactcaatggtcctggtgataagaccggcggcagtggcatgtatctttatcaggaaagcaatctttatgtaacggacggatcgacggtaattgtttctggttatagcggcgaacgcgcaagcggtatttttgcggataactccgaatacgacaatatgccgaaccgtaatattcaggttactggaaattcttcaatcactatcactgactgcgactggcacggtatgactgtcaatccaatcgacattctgattgatgataactcgaagattgatatttctcagtgtggaaatgcaagctatggcggtggccttggctgttattacggcagtgtgacgatttctaatcattccaagcttattactgatgacaataatggcagtggttggggcgtttttgcaaacggtctgaaggttgatgccacttcttcgctcagtgcgtgcaacaacaagggctgcggtgcagcattggcttctaaaagtaagattgaatctggtgcaaccgtaactctgaatgagaatgagaaagatggcttgcgcgtttacaccggctctaattactggtacggtgatgtaacgattgaagaaggtgcaaatttcacagcttgtgaaaataaggataatggcattgaaatccttccagaaggcattctggatatgcaggatggcacggtgacactcaaccatagcagcagctacggcggtggtttgtacaatcgcggcggcactgctaagattggcggcaaggctgaaatctacaataaccatgcagatactgctggcgatgatatttacagcgagacagaaccttctgtaagcctttctcaggtcaataacgggtggatgctggatgactgcaaggaaaagtatcagaaagagcatccgatcgtaggctggtattacgacggcaaggaaaagcgctggaacggtgatggtgaaggcgatgattactacgctgacgaatatacggttggtaaagaagctgtttccgatgcactggctctcaaggctgcacacggtcagctctgcagcgtaacctacgaagtaaccggcgacattccgtctgacgcaggcgcagttccggcagcagccaaggttaagaagggcggcagctacaccgtagcaccggtacagaccacctcgcagagccgctacacgttcagcggctggcggatcaacggcgttggcgatgttgtaaccgagatcaaggacattcagcaggatgtcaagctgatcggcgtatggacccgcagatcgtccggtggcggcggcagcagcagaccgaccgttgacattccggatgatgtaccgaccggtctgaacggtgacgatcactttgcgtacattgtcggctacccgaacggcaacgttgaaccgaatggcaacatcacccgcgcagaagtggcaaccatcttcttccgtctgctgaccgaggaagtccgcaccgcaaattccacccagtccaacagtctgtccgatgtgacgcgcggtcagtggtttaaccatgctgtctccacgctgtcctcgatgggtattgtaaagggtcataacgatggcacgttcgcgccgaatgcgccgatcacccgtgcggaatttgccgcaatcgccgctcgcttcgacgataagaacacggatatgtcctcgaagttcacggatatcgcatctcactgggcaaagaatgagatcggtatcgccgcaaacaagggctggatcaacggctatccggatggtacgttccgtccgaaccagtatatcacccgcgcagaggctatgacgcttattaaccgcgtactcaaccgtctgcccgagaacagcagcgatctgctcgacagcatgatcaagtggccggataattccgatgcttccgcatggtactatctcgctgtgcaggaggctaccaacagccacgcatactcggataagagcaaggacgataagtacgagaagtggaccaccatccgcgacgctcgtgactggaccgagcttgaaaagtaaattattcgtttcggtaaaccgcgaaccacagatgatatagcaagtatcgttttaccgggcacagcagaggcaggaaaaattgcttttcctgtctctgcatttttgtttgggatgggataggggcgtgggcggtcaatggctgcccctgcggagattaaaccgcatgtgtagcagtacgctgtctgtgaactgcgaatatgtcgagaaagacacgcaagagtaacccgactgccgttcccctttttcggagcggtcgccggtctctggtctgcgccagactaacaaacaggggaaaggtaggagttcaaagaggaagggcactcatttaatccacgcacggcgcgggaacaatgtttagcagcctacgggcaaaccgcaggtgtcccttcctttttgtccccgccgcggaagcggcagtttccgcgctccgcagagcgcaactcctcgatgaggttcagcgaaaaactctctgcccggaaagggtgtattgctaacgcaacatgtgcaccagataatcagtgcagaaaaaagtaccgccccggaaagggcgaagtactaacgtacttcgtgtgccccagacaatcggtgcttctaaagaaaaagaaaaagcacttactttcgtaagtgcttaatggtggaagttacagggctcgaacctgtgactctctgccggttggcagatgacgaacccagctgcaatagagaaaaagaaaaagcacttactttcgtaagtgcttgatggtggaagttacagggctcgaacctgtgaccctctgcttgtaaggcagatgctctcccagctgagctaaacttccattttggtgacccagcggggattcgaaccccggacaccctgcttaaaaggcaggtgctctgccgactgagctactgggtcaggtcaaaaaagttttgcgctgagtatgaaattaagtcgcatgccgtaatggcagggacggctggattcgctttccaacgggaaagccacggcggttcgaataatccaccggattattctcaagagccgcctttcgaatccaaggattcaaaatctgccgtaatggcagggacggctggattcgaaccagcgaatgtcggcgtcaaaggccgatgccttaccgcttggcgacgcccccgtattcgtttgctcgaaacagcgttaccctaaagataacgcgctgcgttcgcagcgcgtcacagggttatatggggtgggtaaagggactcgaaccctcgaccctcggaaccacaatccgatgctctaaccaactgagctatacccaccatataaagtttgcagccgacggaaatggcacgccaggagggattcgaacccccggcctactgcttagaaggcagttgctctatccggctgagctactggcgcatatcaattccgacaaacccattcgaagaaaatggagcgggtgatgggaatcgaacccacgtgttcagcttggaaggctgacattctaccattgaactacacccgcgggtctttctgacgctcatttagtatatcaataaaaccctataatgtcaacatcttttttcaaatttttttgaaaaactttttcggccaaatttgcaaagaacatcaaaagggcagacggtcatgctatactgtaatcaaaggagggagagagcatgaaagcaacgatcttactggccgaggacgagcaggccatgcgtgaggtgctgaccgactacttcaccgcaaagagcggcggcgatttcacggttgtgtctgcgccggacggcgacacggcgctgcacttcatcgaaacccggcggttcgacctgctgctgcttgacatcatgctgccgggcacagacggcttcgcgctgtgccgcgcggcacgcgagcagggagacgcgcccattctgttcgtcacggcgcgcgaggacgaacaggacaagctgcacggctacggcctcggtgcggacgattatgtggtcaagccgttctcgctggcggtgctgtacgccaaggcactggcgcttctgcggcgggcgcggggcctcaatgccgagaatacattgacagcgggtaccctgtcactcgacccggaacgggggattgtcacagcggacggcaggcgcatcgacctgccgcccaaggaatttgctttgctgcgggcgctgatggagcgcaaaaaccgtgtgctgacccgtgacgagctgcttaatcttgcgtggggctgggattttgacggcacggaccgcgtgatcgacgggcacatcaaaaagctgcgccgggcactgggacagcacgcggactgcatcaagaccgtggtaaagcgcggctacaagctggaggtggacggagatgaaaaccaaacgtagaaccttttggagctttttcacacgaatcggcgcgggattccttgcattctggctggcagtgatggcggtgttcaccgtcctgctgtcgcagcagcgtgcaaagctcatgctggcggaaatggaaagcaaatcggacaagttgatgggagaggataccgattttttgcttgatccctcgagctatgacacgacggacgagacggaactgcgcagacgattgagcaagccggtattcatggcggacagcgcagacccgcccaatctgcagatcatcgagaccgctatcaccgacctgaactccggcaaagttctgcaaagcaaccgctggtggcttgagttgatcgagggagtcaacctgtaccgcgtggatatgagcggtcagccgcgcgaggtgtgcgaggcggttcttgcgggtgcgggcacaggcgagtcgaaaatagaatcgctgccgaagatgacctttgaggcgtgggcggacagcgtgcccggataccgcgatgacgcctatctgaaatccatcacgatcgagccgaccaagagcggcacttgggagccgaccggagaggtgcgcacgattgaatgcgcatatgacgcggagcaggtgaaaggtctgacgctgaaaaccatgagttgtagtcgcttggtgtgccccggaccgaacggcgccacgaccgaacagattgcggaatccctgtcctcgcccgcgcggcaggcgctgcgggaatgggcagaatacccgagccgcacaaacagcagccaaacggtcgagaagctgtggctcgtgcgaacgtaccggcggacgatcagatattgtccgtttgcggaaagcggcgctgtgctggtgtcctatgcggcggaaggatatccgctcaaagccttgctgccggtactgattcccgtatgggcgttcagtctggtgctggcgctattctgcgcggcagtgctgtccggtgcgcagctgcgcgtctggcgcaaacaggagcgcgtagagcgggtacgccgcgaaacgaccgccgcgctcgcacacgagctgaaaacgccgctctccgtgctcagcgctaccgccgagctgctcggtgacaaccttgcaccggaaaagcaggcgcactatctgggtgtcatccagcagcaggcgcagcggatggacggcagtgtgcggcacatgcttgaactgtcgagattggagaccggcgcaaaggctttgcggcgaaccgcgttctctctgacagaattggcgcaggagcgcctgcaggcggctctgccggccgattccaccatccgcaccgaatttgcagcacaggacaaatttgaggtcaatgcagacagggcactgcttgcgcgggcactggacgcactgctcgagaacgccgtgcagcacacgccggagggcggctgcatcatggtgtacctcgcagacggtgtgctctcggtgacaaacaccggcgaagccattccggcggacgcgctgccgcggctgtgggaggcgtattatcaggccgatccgtcgcgcagcgcaaagggcgacggattgggactgtcgatcgcgaagaccgtgtttgatctgcatggcttcacctgcggagcggagaataccgaaatcggaccgaagttctggttccgatttgccgataaataacaaaaaaccgctcgaaagagcggtttttgctttgttaaataaccttttcgaataccatggttgcctgaatgcggtcgccgcccatcagacccttgctgccgccgttcgatgtagtaatcgtgtgcaggcgataacccttttgcgcttgatggttaatcgcttcttccagttcggtcaggttgccggaaccggtgccgagaaatttttccttcaaagtaacctgcaggacaacgtaatgatagtccttgccggatgcggtggagaaagtcgaggaatcgctgaaatccataaataacatctccggtaatttacacgattatatcgtattcgacagagattgtcaatcaatgcaaccgaagaacggtaaccgagaggcaaagaaaatggagaatgaaaaaatgtggtgcattttccattctccattccgactcgctaagagccgccctgcgggcggttgctcgctggacgcccactgcggtgggtgtctcaattttcgattattagatggtatccagcttaaccttgccgtcctcagcggacaggtgagcgcccatcagcggcttatcaccggtgacgatggcggtggccagcggattttcaatctccttttcgatcaggcggcgcagattgcgggcgccgtacttgaccgagtaggacttctcggtgagcaggccgagcaggctgtcgtcccacgtcaggcggatatccttgtcggccagcgtggtgcgcagctcaccgagcatgatctcagcgatatggcggaagttatcctcggtgagttggttgaacgcgataatctcgtcaatgcggttgagaaactccggacgcatgatttcttcaagagccttcatcacgcggtccttgctcatctgagacacggtgcggccgaagcctgcaggcgtgttattggactgcgaaccggcgttcgaggtcataacgatgaccgtgttctcgaagctgacaacgcggccctgcgcgtcggtcagacggccgtcatccagaatctgcagcagagaattgagcacatccggatgcgccttctcaatctcgtcgaacagaacgacagagtacggacggcggcggatcttctcggtcagctgaccggcttcatcgtagccgacgtatcccggaggggaaccgatcaggcgggaaactgtgtgcttttccatatattcggacatatcgagacgcacgagtgcatccggcgagtcgaacaggtcgagagcaagctgcttgaccagctcggtcttgccgacgccggtcgggccgacgaacaggaaggacgccggcttgcgcttggggctgatgcccgcgcggttgcggcggatggacgcgcagaccgcgtctacggcttcgtcctgaccgataacgtgcgatttcaggcgggattccatatcgcgcaggcgtgcagactcctgtgccgctaccttggatgccggaatgccggtccagatttcgatcacctcagccagaagctgttcgtcaacctgcggtgcaggcttggtcagcagctcgtgcagctgtgcctccacctgcagaatgcggctgcggcaggtggcgatcttggcgtaggtctcctcctcctcagcgcgggcggaggactgggtcagctcgtcaagctgtgcctgcaggcgctcaagctcgttctgcagctcgggaatctcggacagctgcggagaatccagattgagccgcgagcaggcttcgtcgatcaggtcgatggccttatccggcagaaaacggtcggtgatatagcgttcgctcatctcagcggcacggcggcacatctcatcggaaacagtaacgccgtggaaggtctcgtagtacgagcggatgcccttcaaaatctcggtggtctcggcaaccgacggctcaccgatatagaccggctggaaacggcgctcgagcgcggcgtccttctcgatatacttgcggtactccttgagcgtggtcgcgccgatcacctgaatgtctccgcgggcaagggcaggcttgagaatgtttgcggcattcatcgagccttcggaatcgccggtgccgacaatgttgtgcacctcgtcgatgacaaggatgatgttgccgatacgctttacttcgtcgatcaggcccttcatgcggctctcaaactggccgcggaactgcgtgcccgccacgagagcggtcaggtcgagcagatggacctccttgttgcgcatcttgaacggaatgcggccctcgttgatgcggactgccagaccctcggcaacggccgtcttgccgacaccgggttcgccgatcaggcacgggttgttcttctggcggcggttcaaaatctgaatgacgcggtcggtctcgcggtcgcggcccacgatgtggtcaatgcggccttctgcggccttttgggtcaggttctcgcagtaattgttcagatatttgcgctttttgtcctccttgcgggaagaacgggtgcgggtctcctcctgagagccgcctgcgggctgccccggcagagtgccggcagcgaccgggtcggtctcgtggggtgcgtcgtcgtccgtgccgtccgaaccggcgggaaccaggtcgttcaggtcggacagggagccgatctcaccggagagcgcttcgaggtcgtcctcggtgatacccatttgctccatgatgttgtcgagcggcttgacacccagttcgcgtgcgcacttgaggcacagaccctcctgggtggtcttatccggtccctcgattttggtgatgaacaccaccgcgatgtttttcttgcatcgcgagcacattggcatattcataggttaaactccttcagggaatggaaaattgaaaatggagaattaaggtgttctccattaaatggcgataggtaaaacgtccacaagctgtttgagcagcagtgtatgcttgacgcgctccggcgagagatagccgagcgacgtataggtgatcgggaacagccactgcagcacgatcagcaggatgcagacgaatgcgacgccggttacaaagccgatgagtgcgccgcctgcggaatcgagtgcgctgagcggagtacgccgaacaatgagcttgaggctgcggccgaaaatccagatgagccgtccgaacagcacgctgaacagcactaccagcatggagaacgcgatgctctccgacatgccgacagccgcttcggtaacggtctgccgcagaccgtccagcacgccttcggcggtcttgagcgcggcctgtttttcaaacagctgaccgactgccggcacgaccacccactgcgcgatatacggcgcggtgtacttggcggcggcaacagacgcggcgatcatgccgatgcggccaatcacgccgtacagcgcaccgaccagtccccgacgggcaccgagccagacgttggccagcagcacggcaatgaggataaggtcaggcgcgttgagcagctgcgccgctgtggaaataaaatcgttgatatcagttatctgcatgtatttcctcggatcgttcggaatgcgcggtaaagatacgcgcgttgcggttgtagagcaggaaaaccgtaccgtcatcggtcatgagcacacggcgtgcgccgacagcgtcatcattgtgccactgcggctcggcagaggtgttgtagaccgtaacaccggacgcggacagcaccgccgtaccggcgttggagacagcaagcgccgttggctcctcggtcagtgcgaacgggccgtgcaggctgccgttgcggacggtatagagatcgctgcgtgcatcgttcaggtaggagcgcacagcgacagccatcgtactgccctgagacgcagtggcgatcagatcctgcgagctgagttcgagcagcacatcgaccgtgcctctgcgggtgacatgatacagaccggtgtcgcacagcgcgatcgcggcgttgttctcggaataagtgagcgttacaccgagcgcgtcagtcagcgcggtgtccgaaatctgcttgccggaggacacatcaaagaacagcacatgggactcgagcgttacgccgttctgccggaaggcgagaatgccgagcgtattgcagtccggcgagagcacagcggatacaatatagtattccgaagcgcggtatttgaaaacctcttttcctgcggtgtcgtaaacggcagcggcggtacggtagccgtgctcgttggtggtgagcacgaaacggccgctgcggccgatcgaaccgttcaggatggtggattccagcttcagctccgcgacagcgcctgccgagccgaccagtgcggctttgacgccgccgcggtcgtacacgagcacataattcgtgctgctttccaccgcgggatcggagtagccgagcgaatagcgcagcgtggtcatgctgcccgcacgggacaggaacagcgcgtcactgtccgcgtacgccagaccggattcaaacagcgcaccgtcgctgaaggtctcgttttcgtagttgatggtggtgatatcgccgtcatgcgagcgaataccggccgcaatatagctgccgagcgtgcgcagcgaggtcggcgtaaaaatacggtagttggcgatcaggaacagggctgttcccaacaccagagcccagccgcagagcatgcggagcagagcggtcgtgcggatacgcgcgtccttgctgtcgagcaggcgctgacggcgctcccgcctggagagcggaaagcggatgatattctgctttgggttctgttcgctcatgaaatcccgcctccttattgtagcgtgtttaatgggtgaaaatgtgaataaaacttgaaatctgtcagtccgacaggcggaatctgtccagttcgggcgtatcgtcgtaccacaggcggttcataaacagaccgcaggcaggcagggtcggtccggcctgctctcggtcgcaggcgagcagtacgtcgcgcacctgctcgggcgccagcttgccgccgccgacatacgtcaacgtgcccgcaatcgcgcggaccatgttgtacaggaaaccgtcgccgcagacgcggatgcggatgaggtcatccaccggctccacctcacaccagaaaatagtacgaaccgtgctcttgaccggtgtgccctggcttctcacggatgcaaagtcctgcttgccgacaaaatactgtgcgccttcctgcatttttgtaatatccagtggataattgtaccgatatgcgtaccgcgcgtggaacgggtcccgcagggtggaagggaacagataataggcgtattcctttttggtgcagttgaagcgcgcatcgaagtcctcgggaacctcgactgcgccggaaaccgcaatgtcctcgggcagaaagctgttgagtgcatacggcagacggtccatcgggatcgtgcagtctgcgtggaagtttgccacataccggcgggcatgaacgccggaatccgtgcgtccgacaccggaaacatgaactttttgcttcagcagatgaaaaatcgcgtcctccatgctctcttggatggaaggaccgtttttctgaatctgccagccgttaaaatttgtgccgtcgtaggacagcactactgcaatatttttcatcatttcagttacttttagtgggtcgtgaatggagaattgagaatggaaaaatggaaaatgaaggttcggcgcaaaagcgccgattataataaatcgcactttgtgcgataccgcaattctccattctccattatcaattttcaattatcaaaggccaaaatgcttgagtataataacaactgcgaacaaaacagcaacccacagcagcgcgcaaacatctacgcgggcgatcttgagctggcgcatgcgggtacgaccgacatcgccgcggtacagtcggcactccatggcggtagcgagctcgtccgcacggcggaacgccgagatgaacagcggcacgagaatcgggatcatggccttggcacgctgaatcaggttgccggagtcgaaatccgcgccgcgcgccttctgtgccgagatgatcttctcggtttcttcgatgagggtcgggatgaagcgcagtgcgatcgacatcatcatggacagctcatgcaccggcgcgtgcagctttttgagcggagaaagcagacgctcgagtccgtcggtcagctgaatcggtgaggtggtgtaggtgagcatggaagttgcgatgatgagcagcatcaggcgcagcaccatgaagatggccagcttaatgccttctacactgatgtgcaggaagtgccactggaaaatgtaggtgcccggtgtatagaacaggttgagcaccgccgtgaaaatgacgataaataggatcggcttgaggccgcgcagcaccattttaggcgaaatacgcgaaataccgatgacaacggcaagaaatgcgatgatcagcgcataggaaaccgggccttgcgcgaggaacagaagcacgatgaatgccaccgtcagcacgatctttacgcgcgggtcaagacggtgcaccgcactgttgcccggaaaaaactgaccgagggtaatatccttcagcattcgtgagcagcctccttccgcttgcaggcacgcagggcatccattgcctgcgctacggtgtagaccgaggtatcaacatcgtgaccgcgctttttcagctcaagcataaccttggtgatcatcgggatgtccagtccggcggcaatgatctcgtccgcgtgcgagaaaacctcgcgcggcgtgtcgcagaacagcaccttggcgtgattcatcacaagcagacggtcggcaacctgtgcgatatcctccatcgagtgggacacgatgaggatggtcgcgccggactgcttgtggtagctgcggaccagctcaaaaatctcgtcacggcccgccggatcgaggcccgcggtcggctcgtcgagcacgagcacatccgggcgcatggcgataacgcctgcgatggctacgcggcgcttctgaccgccggacagcgcaaacggagactggtcggcaagctcaggcgcaagaccgactgccgccatggactcgcgcacgcgctcgtcaatctcatcctgcggcagcttcatgttggtcggaccataggcgatgtccttcgcgatggtctcctcgaacagctggtattccggatactggaacaccagaccgacgcggaagcgcgtttcgcggctgcacttgcccttggcatcccagatggacttgccgtcgagcaggacctcgccttcggacggctgcagcagaccgttcaggtgctgaatgagcgtagacttgcccgaaccggtgtgaccgatcacaccgagaatttcgcctttttcgattttcaggtcaacatggtcaagcgcaacacgctcaaagggggtgcctgcgccgtaaacgtgcgtcaagcccctcgtttcaagtatggttgacataagattctccttcggataatcaatggagaatggaaaattgctaatggaaagttaaggtgtccgtgcgaagcacggttataaatgcgccgtgcagcggcgaaaccatcattcgccattctccattttcaattttcaattcaaatattcttgttcgagaatatctgcacattcctcgatcgaaagtgcgtcgatcggcagcttttcgccgtcctgctgatcgaggtcgtacaggacttcgatggtctgcggtacggtcagggaagccgcgcgcagcttgtccacctgcgtgaagatctcgcgcggagcgccgtccatcagcacgttgcccttgtgcatgacaaccacacgctgcgcctgtacggcctcgtccatgtggtgggtgataaggataacggtgatgccgaatttgcggttcagctcacggacaacattcatgacctcacggcggccctgcgggtcgagcatggcggttggctcatcgagtacaacacagcgcggcatcatggcgataacgcctgcgattgcgattcgctgcttctgtccgccggacagacggtgcggcgcctgtgcacggtattcgtacatgccgacggcacgcagtgcatcgtcaacgcgcttgcggatctctgcgggcggcacgcccatgttctccagcgcaaatgcaacatcttcttcaacaacggtagcaacaagctggttgtccgggttctggaataccatcgaaacggtttttcgcacctcataggtgttgttatcgtcgcgggtgtccatcatgtcaacgtagcatacgccgccggtcggcagacggatcgcgttgaagcagccggcaagcgtactcttgcccgagccgttgtgaccgagcaccgcgacgaactcgccgcgccggatggaaagatttacgccctttagcacaggaacggaaagctgtccgtcctcggtgggataggcgtactgcaggttttcggttttgatgatttcactcatggtttcgtacctttcgttacggtaaagttggtgacgaattgagaattgaaaatggagaatggataattattcggtcagatttgtccgggtggttttaacaatagccaccagcagacgtttgagagatgccgcttcgcgataaaaagaaacatactgttcttttgttagaaaatcagtagcattcagtaaatccagccagtacagcgtttcgtctgcttctttcagtgcaatgctgattttggcaagaaagtcctttttgctttgcgcctgctgtgcttcacgaacattggctccgatactggtaccgcacttcattagctgacgggaaagaacaaattctttcttatcatttgcaagggatgtacataatttaacaattcgtactgcgaaggagaaactttgcgtcaggattacattttccattctcaattctccattttcaattttgcttattcctcggcgataaaccgtgccgacgagccgcacggcagcaccagaccggtcgattcgaccggcaggccaagctcctgcgcctcaatcttgccggcggcgcgtttgcctgcggtgatgccgagcagatagctcatcacagacggcgccagaccggtggaatagctggaaatgagcacgaacagcggcttgtcgctcagcacgcccatggtcaggtcaatgaagtcggcaacgtcctcctcgatcttccacgtctcgccggacggaccgcggccgtagctcggcgggtccataataatcgcgtcgtacttgcgtccgcggcggatctcgcgctgcacgaactttttgcagtcgtccacgatccagcggatcgggcggtcactcagaccggaggacgcggcgttctccttggcccactgcaccatgcccttggacgcgtcaacatggcagacagacgcgccggcgtttgccgccgcgagcgttgcaccgccggtgtaggcgaacaggttgagcacgttgatcgggcggcctgcgtgacggatcatcttgtcgataaaatcccagttggcagcctgctcggggaacagaccggtatgcttgaagctcatcggcttgagctggaacgtcaaatcgccgtagtggatggcccactgctcgggcagcttgcggatttcccacttgccgccgcctgcgttcgagcgatgatagatagcgttcggcttgttccaaaccttacagtccttgtcgcgcggccagatagcctgcgggtcggggcgctgcagaatctgattgccccatcgttcaattttttcaccgccgccgcagtcgagcacggcgtagtccttccaatgatctgcgatccacataaatattctccattacattatatataagtagttgtttacacaataattcagtatctattctaccaccaaatatgcactaacgcaatgaaaagcgattagaaataaaagatgtcaagacagcgtattttggcgaatacagcaaaacggctgcaccgcaaagtacagccgttcgagcgggaaaagcggtcagaaccgttcgcagtagccttcgccgccgtttgcaagcgacttgagggcagtttcgcggcgttcctcaggctcgtccgagatacataccgcatcggtcagcacctgccgcgcctgatacggcagatcgaagaattgctccattgcccgcggactgtgtcccatttcctgcataaaatgaaagggaatatcaccggagacctgttttttcctgtcctgtgccataattgcacgctcctttcgattgcagtatctccgggaatcgtgctataataccattataaaattagtaatgagtcattagaaattagtaattatagagtggagagtgaagagttgagagtggagagcaccttatctcttcactctgcaatctccactcttcactctcatatcaaggggtaagaaatggatttacagaagaacaaggtttatcgttgtcagattacggattacacagcggacggtacggggtttgcgaagatcgaaggccgggcggtatttgtgccgcgtacggcagttggcgatcagtgcgatgtacgcattgtcaaggtgacgaaaaatgtggcgttcggcagggtagagaagattattgtgccgtcggcacagcgtactgcgcctgcatgttcggtggcagataagtgcggcggctgctgttatcagcacatcacctacggggaagaactgcgtgcgaaggagaaaaaggtgcgtgatgcgctgacgcgcattggcggtcaggacggcgcaaagctgctcggcattacgggtgcgccgacgactgagcattaccgcaacaaggcgcagtatccggtcggacgggacaaagaaggcagcatcgttaccggcttttaccgtccgcgcagccacgacattgtgccggtggagaaatgcctcatccagtcggaaacggcggacaagattgccgccgtggtgcgtgaatggatgacggaattttcggtcatgccgtacgattatgagaaaaaacgcggtacgattcggcatatttatgttcgcgtgggcgaaaaaagcggcgaaagccagctgacgcttatttccgcaaccaagaaaatgcccaaactggatgtgctggtcgagcgcctgcgcgcggcagcgccgtcgctgacgggtattctgctcaaccacaaccagcgcgacgacaacgtgattctgggtgaccggacggatgttctctggggtgagccgatgctggaggaccgcctgtgcgggcacacgtttttgctctcgcccgaggcgttttatcaggtcaatcacgcgcaagccgagcgtctgtatgcgtgtgcggtggattacgccggtctgaccggcgaggagaccgtgcttgacctctactgcggtgcgggtacgatcacgctggcgctggccgagcacgcaaagactgccattggcgtggaaatcgtaccggaggccatcgaaaacgccaagcgcaacgcgctccgcaacggcatggaaaacacagagttcttctgtgcggatgcgggtcaggcagcgcagcggctggccaagcgcggtattgatgtgctggttgtcgatccgccgcgcaagggtctggacgcgactgcacgcgacgcgattcttaaaatgcagtcgcctaaggtcgtgtacgtttcgtgcgacccggcaacgcttgcgcgcgatgtggcggagctgtgcggcgcaggctacacactcgagaaggcacaggcgttcgatctgttcccgagaacttttcatgtggagacggtctgcctgctgtcgaagaaatcttgagtttatgcgggttaacgggcttttttagagaatatatacctgtgttctgacaggaaaaatgcatataaaataaagaaagttttgatatcaatatattctgtaagatttctaagaaacgtcaggatttcgcgcaagcgccttggcagcgtaccggaatatcgttttgccctgttcgttaagctcgctcgtctggcgctgccggtattgcggacacatgatttgtcctgttttccgatggcggcgttatattcctcgtaattctcaatgtcatccgtgcgctgcgcgtgcccaatcggcaggattgctgtgtaataagcattgacaactcccgctcataggagaataatagtacacgagtatagagcaaaactgtcgacggcatgaagccgcgaggagatatagatatgacattggataaactgaagccgcatgaaagtgcgaagatcaccgcagtaggcggaagcggagccttacgccatcacctgctcgatatgggactgacgccgcagaccgaggtcacgctgcagaaggtcgctccgatgggggatccggtgcagtttgagctgcgcggctatgaattgaccctgcgcctggatgaagcgcggaagatcgaagtcggcacgccgtatcagcgaacccaaaagccttccgccggacaggtacgccaccgtcctgcggcgcaccccggcatgggtgagctcaggaaatccaaggactaccacatttatgagcacgccaaagccgcgactgccgataaaaaactgacatttgcgcttgccggcaatcagaactgcggcaaaacgacgctgttcaatcagctgaccggtgccaaccagcatgtcggcaattttcccggtgttacggtggaccgcaaggacggcacgatccgcagccatccggaggcaaccgttaccgacctgcccggcatctattcgctgtcaccgtattccagcgaggagatcgtaacccgcagctttctgctggacaacaagccggacggcatcatcaatattgtagacgcgaccaacattgagcgaaacctctacctgaccatgcagatgatggagctgggcattccgatggtgctggcgctgaatatgatggacgaggtccgtgcgaacggcggcaccgtccatgtaaatgagcttgagcaggcactcggcattccggtagtgccaatctcagccgcaaagaacgaaggcattgatgagctgatcgaccacgcgatccacatcgcccgctatcaggaaacacccggaggcatcgacttctgtcaggacagcagtgataagaacgatccggtagccgctgttcaccggtgcatccatgcaactgctctgatgatcgagccgaatgccaaacgagccggtctgccggtgcgatttgccgccaccaagctgatcgaaaaggacccgctcatcgaaaaggcgctcgcgctgtccgatgacaatcgctccgcttttgaccagatcgtatccgtcatggagaaggattccggtctggatcgcgaagcggcgctggcaaacatgcggttcagctttctggaaaacctgtgcagcacaacagtcgttcgcccgcacgagagcaaagagcataaacgcagtatggcgatcgaccgctttttgaccggcaaatacaccgctatcccttgctttgccggtatcatgggtttgatcttcatcatgaccttcagctggatcggcgcatggctgtccgacggcatgaccgttctggtcgatacctgcatttcgtggctggatgccggattatccgccctgcagataaaccccgttgttcactcgctcgttgtagacggtatcgcaaacggcgttggcagcgtactcagtttcctgccgaccattgtaacgctgttcttcttcctctcgattctggaggacaccggctatatggcgcgtgtggcctttatcatggaccggccgctccgcaagctgggactgtccggccgcagctttgtgccgatgctggtcggcttcggctgctcggttccggccatcatggctacccgcacactgtccagtgagcgtgaccgccgcatgacgattttacttaccccgtttatgagctgctcggccaagctgcccatctacaccatgatgatcagcgcctttttccccagacggtatcgtgcgcttgtcatgattggcctgtatctgttcggcattctctgcggcatcctgtatgcggtcattttgaaggtctcccgcttcaagggcgaaccggttccgttcgttatggagctgccgaattaccgtctgcccagcgccaaaagtgttgtgcacctgatctgggaaaaggcaaagggctttatccagaaggcatttaccatcatctttgctgcttctatcgtaatctggttcctgcagaccttcgatgcacgctttaatgtggtgtctatgccggaaagcagcctgctggctgcgctgggcagcatttttgcaccgctgttcgcaccgctcggctttgcggactggcgtgtgtccaccgccctgattaccggctttactgcaaaggaaagcgttgtatccacgctgaccctgctgcttggcggtgaggtatccagcatcggcaccctgttcacgccgtttaccgcggtcgtatttctggtattcgtgctgctctataccccctgtgttgcggcaattgccaccgtaaagcgcgagatgggcagcacgcgggctgccatcacgactgcgctgacccaatgcgtgatcgcatggctcattgcctttgccgtccgctgtgtcggtctggcatttggcttggcataaggagacacggtatatgaatcttcccaccattttgattctggcattgatcggcattgcgctgtttgccgcgctccgttcgatgaaaaagcatccgtccggctgttccggacactgctccggctgtcccgtgcagtgcaaaagcgaaaaacacagataaaacagcagcctgtccgctccaagagcggacaggctgctgtttatcggtttctgaaaaaagagggcaggccttctgcccaccctctgaataatctcaattacttgttgaagtaacgcttcagcagaccctcgaaagccttgccgtggcgggcttcgtcgcgtgccatctcatgtacggtgtcgtggatcgcgtcgaggtttagagccttagcgcgctttgccagatcaaacttgccggcggttgcgccgttctcagcgtctacacgcatctgcaggttcttctcggtggagtcggttacaacctcgccgagcagctctgcgaacttagcagcgtgctctgcttcctcgaatgcagccttctcccagtacaggccgatttccggatagccctcgcggtgtgcaacgcgagccattgccagatacataccaacctcggagcactcgccctcaaagttagcacgcaggtcagccatgatgtcctccggagcgccctgtgcaacgcctacaacgtgctcagcagcccaggtcttttcgccagcctgctccttgaacttctctgccggtgcgtggcagatcgggcactctgccggagctgcttcgccttcatatacataaccacatacggaacaaacaaactttttcatgattttttcctcctgtatcgttgaacaaatttatttttgagggggcaggaaacgatccattgttatcgaacaaagctgatcgcgcagagaccgattgatctccgagaacacgcgatgaaaatcacattcattctgggtacccatgtgtgtgcactggaactcatttgcaaggcagtgattgatggcgatcggaccatcaatgcattcgatgatcgcgccgagactgatctccgatggggagtggttcagctcatagccgccggcaacacccttataggattttgtaataccggactgcgtcagcttgcggagaattttaagcgcaaaccggagtgttacgccggttgcctcggaaatatccttcgcgcactgcttttcgcctgcaagtgccagacaataggtcacacgaattgcataatccgcttcatgtgtgattctcaaatcgttccttcctttctctccttggaacaactttagtataaccgtgttgtgccaaaatgtcaataggttttcttaaaaataaataatattttttatttgataatagttatcaataagtaacttgcttttggatcggattaactataccagataaggacagtataccatggcgggagacttttgtctatcggttcaggaatggagaatggaggatggaaaatgaacgtggagattcagcattcttcctttattcatttgtattgtgcgatacgatggggaaatgcgctttgaatctttgcaccgatttcattctgtgcgcttgtactgtataataggtaatgcaaaatgcaagtacgaaaaattttccctttcacaaaaccatttgccgcaccgaaccgtctaatagatgaaagccgcagacaggaagcgcttttgacgaaacctgtctgcgctgtccggacgctttcggaaaggagaattcgcttatgatggatagagagcaatttacctccgcggtgctggcagccgagcctacgctgtaccgcgtagcgaaaaccatgctccgcagcgagcatgactgtgctgacgcggcgcagcaggcaatcctgcgggcgtgggagcagctggattcgctgcgcagcacgcggtatttcaaaacgtggctggtccgcatactcatcaacgagtgcagcacgatattgcgccgtcagcagcggcttgcgccgtatgatgcggctgctgcagaggcgataccggcgcctgcggctgatgatcacagcgacctgtatgccgccatcaccgcactggaggaaaagctgcgcctgccggtggagctgtactacttagagggcttcaagacccgtgagattgccggaatgctcggcataccggaaaacacggtcaagactcgtctccgagcggcaagagagcatttgcgcaaggacttgaaaggagcgtgcttcgcatgatgagccataatgatttcccgaaaatgaccgaagaatttgaccgcagtgtccgcagggcactggacagcctgcccgagcgagaaagcaagccggtacgccgtttctcagcgaagaaaatcgtctgcgccggactggcggcagcgctgtgcatcggcggaaccgcattcgccgcgaatgcacagagctggtttccactgctgtttccgaatggcggagacgcgaatctcgaagggtatgtgcagacggcggacagcaccaggctgaccgacgagaacgacagctaccgcctgtccgtagaatccgtgctgtttgacgaaagcgcgggcacgggcgtgatcagtctgcaccttgcaaacaaaaagcaggacggcgtaaagccgttcacgctggcgcacctgatcgacagctatcagaacaagccagacatcacatggtccacgctgtcctcgtgctatgccgaggagggacagcttgatttcgaggtgatgtacggcgacagcggcttctgcggcggcgagttttacctcgataccgcgcgttcgaccgacaacgactattatttagaaggtgcgtttgcgatttcaagcgattacaggcagggagagccgctccgtctggaggcgctcgagccgggtaaaacgaccgtgcgtgcggacggagcgggtaccgcaaagacggttctggcggtcgatctgccggaatttcagcagatgccgtacctgacgagcgcagacggtgatgtaactctgtcgcagatcggcattcgcatccgcaacgcggatatgcactgcacggtggatgatgtggatacgctgagcgtgcagctgaaggacggctcggagtacgttattctggatgaaaacgccgatatcgatcggacattgtacacttacggtttcaattccaccgaggacaccgaccgtatcgacaccgagattgccgtgctcgcgcgtgcgtttgatctggataatgtgcagtccgttaccatcaacggcgaggtgtatccgctctcgtgataaacggcaggatagagcaaaacagaccgcaaatgcggtctgttgaggctgtcgcgaaactacagtttcgccgacaagcaggaacggaccgtgggccgttccaaagtcgtccgaaagttcctatacagaaactttctccctccagaagtgtaaaaaccgagatacatgctcccggtttttacgaatttgcgaagcaaattctattttatgcgcgctgccgcgcgaattatttgaaattgtgggaatatggactttttcgacaaactaaacagaccgcaaatgcggtctgtttttgcgtttatgcagtgaaaagctgcgcccagtacgcagttccgttcacaacggtacagccgatgccgatggtggtgaagctgctgctgagaatgttcgcgcggtggccggacgagctcatccacgactggacaacagcctccggtgtgctctgaccataggcgatgttttcaccggcacgcgcgtaggaaacgccggcctcggtcagcgcggtaaagcaggatgcgccgctcggacgtgtgtgcgaaaagctggtttgcagttctccggcgcgggtctgcgccgcctgctgcaccgtggtgctgacggtcagcgcggacagtccctgcctggcacgctcggcgtttaccagagagaccacctgcgcggcgtagctgctgttcgcggcggtgctctgtaagggcttgctcgccgaaggacggctgaccgtctgcgtgtaactcggacgcacggcgaacgaaaagcggttctgcggcagacgtgcagcttctgcagcggcggtggatgcgatggcaagcgcgagtgccagcggcacgagtcttttgaacttcataggtaggtacctccttggattttgcgggaaattcccatgcaccgtatgatagcgggttttgtaaccgttttgcaatggaaatccaaggagaaactgccggaatacggaaaaaaccgaccgaaacagggaaaactcggtcggtttggtgaattttatcccagcttttcgatgtcgtacaggctgttcagcacaagccacagctgcggaaaataccgcataatattccagatgctgacgcctgccagctgatattctccggcaagcgccagcttggcgcggacagaacgcgcgtcctcgaaccagacctcgtgctcggcacggtcgcgccagtagttgtagtgcggagactgcgccgtgtcatcatagcgaatcggcgcgccgacctgaatcgcctgctcgacggcctgcacgctgcccagactgcgggcgcgtgactgtccctgcacatagggcagcgtccagtcgtagccgtagttcgggatgcccatgaacagcttatcctgcggcacctgcgacacggcaaaccgcacgacctgctctaccttgttaatcggcgcgaccgccatcggagcggacaacgcataaccccattcataggtcatcagcagggcacggtccgccgcagagccgagcgcggcatagtcgtgcgcttcatacagaagaccttgctgcgcggcggaggttttaggtgcgagtgccgcgaagaccgtgtatccggcaggcgagagccgctcgcggaccgagcggacaaacgcggcatacgcgtccgcgtcctccggcggcacatactcaaagtcaatgtccacaccggcgaagccctgcatggcaagcacctgtgccagattttcaatcagcgccgcgcgagccgtcggggtgttcagcagccggtgggcgcgttcgccggagaactgcccgtcctcgccgagtgttgtcagcacgagcaaaggcttcacctgatactgccgcgccatgcgcacgagcagctcggcagagaacggtaaaatgcgtcctgcgttgtcaaaaccgacggaaaatacggataagtatgtcagatagggcagtgtgcggcgcagaacgcgcaggtcgatgctcggataggcgtagccgttcaccgcaaagcgtcccagcttgtttccatagctgagtacaagcatctgccccggctgaatgcggtcggtgctgccaagctgcggattgttctgccacagctgcatcacggttgtgccgttctgcgcggcaatactgccgagcgtgtcgccgcggcggacgatgtacgtcttttccggctgcggaacgacaatggtctgcccgggcgtaagccggtacggctcgtgcagctcgttctgctggatgaggaacggcaggggaacactgtgcagctgtgcaatgcggtacagcgaatcgcccggctgaacaacatggatcaccatagaaaaaccacctttctcctgcattttatgcaggggaaaggtggttttgtgaattgagaatggataattgaaaatggagaatgaatgttgcggcgcgtagcgccgttatttaatcatcgcgcaatgcgcgataccacaattctccatccttcattctcaattttcaattactgcttacagcaaaatagcagagccgatggaaacgataagcgccgtcagcagaccggcaacgccgatcgccagaccggaaatcgcgccttcggtctcacccagctcaatggcacgcgaggtaccgaccgcatgggaggccgtgccgatggacaggcccatctgcaccggattgcgtacgccgatgcacttgaggaaggtcggcaggatgatcgcgccgatgatgccggtgatgacaaccgcaatcgcggtgatggaggttacgccgccgagcatttcggctaccgcgaccgcaatcggagttgttaccgatttcggcacgagagaaagcgtcgtgctttcgctcagaccgaacagatggctgaagagcagcacgctgccgatggataccatcgagccgacgaacgcgccaagcaggatgggcagcaggtttttcagcagtacatccagcttgcggtaaatcgggatcgcaagcgctaccgttgccggtgtcaggaagaacgagatcagcttgccggattcctcataggtctggtagggggtgccggttgcgatcagcagcgcaccgaccagaatcgaggcaatcagcagcggattgcagaccggagagccggttttcttttgaatctctacgccaagcgcataaaaaccgatggaaatcagcagccagaactgcgaggaggagagaagatcagtcatggtcgaacgcctcctcggtttcacggtgctgcagacggaacacgatatgtacggtcagtgcggtagcagcagcagtacacagcgtggtcagcaggcagacggcaaggatggcgagtgcttcacttttgatgtcgttccagatttccagcacgcccagcatggcgggcagaaagaaaaatgccatgttctgcagcagaaaatccgctacgctctctacatggtgcagacgaaccgcaccgaagatgagcagggcgagcagcagggtcagaccgagcacgttgccgggcagcagaccgcggagtaaaagggagagcagtgagccgccgacacagcaggcaagcagcacaccgagttgcttcatgtgtttcaaggtttttgcgcttctttctcgtttgcgtagtttttggtcattgcggtgagcaatgtttggtagatggcctcggcgttttccttaaaggtacgctcgagcatggcagcctgtccgtgactgacgacgttcatttccaccgcgaacacctgctccatttccatgcggacggtcaggtcgttcgggccgtgctcggtgacggcggtgtggatgccggcgtcgcgccgaatctggcggacgacacgcagcgcagagcgctgtgcggcttcgcggaccggatagggaagctgcttctcgaaaatgcgggtagcctcgcgtcccttttcggtgatggcgtacagggtttctcctttgtcggggatctcctcgatgtgcccggtcgggatcatctcgtagaaagcctcgctcagctcgaagtagccaaagccttcgtcgcaccaggtcgttaagtccacaatggtgctgaagctgaccggaaatggcagcagatccatggcgaacaggaccagaaacttgatatcctctttggtatggataaaaccgtagcgaaccatatgcgcgatgcctccttctcttccccggcagggcgaaacgccgttttcgtcagtgcttttcatagtatactactcggcagggcaaaatgcaatcggctgaaatgacaaagaatattatatagaacggcaagaattatactgtaaaaaaatcagcagatacaaggcgaacaaatgtgcgattttttgataatctcctattgaacataaaaaatgaatgcggtatacttatatcgagattatgtcgaaacgaggaaaaaatcatgccggaagttgttctgcgtcctgcagaggaagaagatattgccgagatgcttgcgctgtatgcgccgtatgttgttcaaaccactgtgtcgagcgagtacgatgctccttcgatagaggagtttacccgccggtggcgcacctatacccaaaagctgccgtggctggtctgccgtattgacggcgaggtcgttggctatggctatgctgcgccgcaccgtacccgcgctgcctatcagtggtcggtcgaaacgtccatctacgttgcacaggagcagcaccgccacggtatcgccggtgcgatttacgccgcgctgtttgaactgctggcgatgcagggatactataatatctacgtcggcattacttcaccgaatgagcggtcgatgaagttccataaagccatgggctttatcatctcgggcgcatatcaggaaagcatgtataaattcggtcagtggcgcgatgtcctctggatgggcaagagcctgcgtccgcatgacggcgcaccgcagccgaccgttccgttcccggagattaaggacagtccgctggtaaccagagcgctcaaccaggcggtggagaagattcatttttaatggagaattgagaatggataatggagaactcaggcaacgccgcgaagcggcgtattaaacaatcgcgcagagtgcgatactgctttcaatcttcaattctccattctcaattttgtacagggggagggaatgcagatgccggataacccgcatatgggccatcgccagcgcatgctggacaaattacgccggttcggactggagatcttcagcgaccacgaggtgctggagatgctgctgtattttgcggtgcggcagggcgacaccaacccgacagcacaccggctgatgcagcggtttggttcactgcatgcggtgctcgaggcaaccgaggacgagctgcagacggtcgaaggcgtcggtccgcgctcggcggagctgctgcacctgtgctttgccctgtttcaccgttatcaggcggatgtggcgaaaatggagcagtttaccgataaactgaacacctatgaccgcatcggcgcatatttcgtgccgcagctgtgcgccgagcgggaggaagtgctgctggccgcctatgtggatggcgcggggcgtgtgctcaagtgcgaggagatcgcccgcggcggacatgcgcgggtgcaggtggacagctacaagatcgctcgcggtgccttgatggccggtgcggcaggcgttgcgctggcgcataatcatccgaacggcacgccgacaccctcgcaggaggattttgatatgaccgaccgcctgcagcgcacgctctccgaactgggtttggagctggtcgatcactgtgttgtggcacgcagcaatttcacatctatcggtcgattaagaagcggcagcctaagaaaacggtactgatttgtaaacggtcgaagtaatggaaaattgagaatggagaattgagaattaaggaaccgtgcatagcacggaatttgatacgccgctgtgcggcgcacattcattctccattttcaattctccattctcaattactgcacacgctaagagcaaagagggaggtctatttccttgcctgatttcaagatacacagcccctaccaaatggcaggcgatcagccggaggcggtggccaaactggtggagggcatcaacaacggtctgaccgagcagacgctgatgggcgttaccggctcaggcaagacgttcaccatggcgaacatcatcgagcagacccagcgcccgacgctggtgctcgcgcacaataaaacgctggccgcacagctctgcaccgagctgcgcgaattttttcccgagaatgcggtagaatatttcgtatcctactacgattattaccagccggaggcgtatatcgcctcgaccgacacctatattgagaaggattccgccatcaatgatgaaattgaccgcctgcgccactctgcgacctcggcgctgagcgagagacgcgatgtgatcattgtgtcgtccgtgtcgtgcatttactcactcggcgatccgatcgactacaaaagcatggtgatttccatccgtccgggcatggagatgagccgtgatgagctgattcgccgcctgattgcgattcagtatgagcgcaacgacattgcgttcgagcgcaaccgcttccgcgtgcgcggcgacacggtggaaatctggccggtatactcggatgaggatgttgtccgtatcgagtttttcggtgatgaggtggaccgcatcagccgtattaacccgctgaccggtgtttcgctcggtgaactgggtcatattgctgttttcccggcgagccactacgtcacgcccaaggaaaaactggaggaagccatcaaggatttggaggaagaactcgacaagcgcgtaaaatacttcgaggaaaacggcaagctgatcgaggcccagcgcatcgcgcagcgcacccgctacgacattgaaatgctgcaggagatcggcttctgctcgggcgttgagaactattcgcgcgtactgtcgcggcgtgcgccgggaagtgcgccgtatacgctcatcgactattttccgaaggattttctgcttatcgtggacgagagtcatgtgacgcttccgcaggtgcgcgccatgtaccacggcgaccgcgcccgcaaggaaagcctggtcgaaaacggcttccgcctgccgagcgcgtatgacaaccgcccgctcaattttgatgagtttaacgaccgtttgaaccagattgtgtatgtttccgcaacgcctgccgagtacgagctgtcgcgctcgggtcaggtggtcgagcaggtcatccgcccgaccggtctgctcgatccggaggttgttgtccgtccggttgatggtcagatcgacgatctcattggagaaatcaacgcccgcaccgccaagggagaacgggttctggtcaccacgctcaccaagaaaatggccgaggatttgaccgattaccttgaaacagcaggcatcaaggtgcggtatatgcaccacgacgttaagaccatcgagcggcaggagctggtgcgcgatctgcgtctcggcgtgtacgatgtgcttgtcggcatcaacctgctgcgtgagggtctcgacattcccgaggtgtcgcttgttgccattctcgatgcggacaaggagggatttctccggtcggagacctcgctcatccagaccatcggccgcgccgcacgaaacgagcacggcatggtcgtgctgtatgcagacagcatcacgccctcgatgaagcgcgcgatggacgagaccgagcgccgccgtgcgctgcaggatgcgtttaataaggcacacggaattatccccaggtctgtgcataaaaaggtgcaggatgttatcgagatcacctcgaatgtgccctcgagcagcaagaaaaagctgcgcagcaagggcgaaaaacagcaggagatcgcccgcctgacccgccagatgaaggaggccgcgaagatgctcgagtttgagatcgcagcacagctccgtgatcagattaaggcgcttgaaaatggataatggagaattgaaaatggaaaatgtcgctattcttgcgcgagttctgtccgcgctgcgacaaggtgcgccgctttgcggcgataattctcaattctccattctcaattttcaattactcaacccgttatgcgtaacaataaaggaaaataaaaatgcaggaatacattcacgttaaaggtgcgcgagagcacaacctgaaaaacatcgacatcaagattccgcgcgacaagctggtggtgttcaccggcctgtccggctcgggcaaatcgtctctggcgtttgacacgatctacgccgagggccagcgccgctacgttgaatcgctgtccagctacgcgcggcagttcctcggccagatggacaagccggatgtggactatattgacggtctgtcgcccgccatctctatcgaccagaagaccacctcacagaacccgcgttcaacggtcggcactgtcaccgagatctacgactatatgcgcctgctgtgggcgcgcatcggcacgccgcactgtccgaaatgcggtaaggagatccaccagcagaccatcgaccagatcatcgaccggctgatggcgctcgaggaaaaaacgcgcgtgcagctgctcgcgccggtcatccgcggcaaaaagggcgagcacgttaaggtgttcgagaacgcccgcaagcagggctatgttcgcgtgcgcgtggacggcgagattcacgacctgtccgaagaatttaagctggcaaagacgaaaaagcacaacatcgagatcgttgttgatcgtgttgtcatccgtccggacgcccgcggacgtattacggattcggtggagaccgcctcggcgctgtccggcggccttgtcatcgcggatgttatcggcggtgaaccgctcacgttctcgcagaactatgcctgcgacgactgcggcatttccatcgaagagcttaccccgagaatgttctcattcaacaacccgtatggcgcgtgcccggtgtgcaccggtctgggcatccagaagcgcgttgacccagaccgcgtcattccgaaccgccatctttccatcaagcagggcgctatccgcgcgcccggctgggggagcgccgacacgggcagcatcgcggcgatgtactacaacgcactcggcaaaaagcacggctttacgctggaaacgcctatcgaggagttctccgagcaggcactcgacgagctgctgtacggcaccggagatgagccgctcgagctgtcggtcagccgcatttcgggcggcgtgatgcgccagccgttcgagggcatcatcccgaaccttgaacgccgctaccgcgaaactaacagcgagtggtcgcgcggcgagattgaagaagtgatgagcgaaagtccgtgtccggcgtgccacggccgccgtctgcgcccggaggtgctggcggtcacgctcggcggactgaatatcgcggagtttgcggaaaagtcggtcgtcaaggcgatggagttcctccacacgcttaagctgaccgaaatgcagcacaaaatcggtgacagagtaatcaaggagatcatggaccgtctcggctttttgcagtcggtcggactggaatatctgacgctttcgcgctcgtccggcacactgtccggcggcgagagccagcgcatccggctggcaacgcagattggctcatcgctgatgggcgtgctgtatatcctcgacgagccgtccatcggtctgcaccagcgtgacaacgacaagctgcttgcgaccctggggcggctgcgcgacctcggcaacacgctcatcgtggtcgagcacgacgaggacaccatgttcgcggctgaccacatcgtagacatcggtccgggcgcgggccgcaacggcggcgaggtcgtgttcgagggcacgatagacgagctgctcaaaagcgacaaatccatcaccggacagtatctttcgggcaaaaaattcattccggtgcccgaaatccggcgcaaaggcaacggcaagagcatcacggtcaagggctgtgcggtgaacaacctcaagcacacggactttacgattccgctcggcacgctgacctgtgtgaccggtgtttcgggttcgggcaagtcctcgttcgtcaacgaaatcctgtataagaagctggccgctgagctcaatggcgcgaagactcgagccggcgcgcacgatgcattcctcggcatcgagaatctggataaggtcatcgacattgaccagtcgcccatcgggcgcacgccgcgctccaacccggcgacctatacgggtgtgttcaacgacatccgcgacctgttcgccaagacggcggatgccaaggcgcgcggctacggcccgagccgtttctcattcaatgtcaagggcggtcgatgcgaggcgtgtgcgggtgacggcctgctcaaaatcgagatgcacttcctgccggatgtttatgtgccgtgcgatgtgtgcaagggccgccgctacaacaaggaaacgctcgaggtgcgctacaagggcaagaacatctatgaagtactggatatgacggtagatgaagcatgtgagttcttcgccaacgtgcccaagatcgcacgccgattggagactatgcgtgaggtcggtctcggctatgttaagctgggtcagtcctccacgacgctgtccggcggtgaggcgcagcgcgccaagctggctaccgagctgtccaaacgctcgaccggcaagaccatctatatcctcgatgagccgaccaccggcctgcacgttgcggatgttcaccggctggtggatgtgctgcaaaagctggtcgaggcgggcaacacggtggtcgttatcgagcacaatctggacgttatcaaaacggcggactatatcctcgacctcggtcccgagggcggcgatggcggcggccgactggtcgtctgcggcacgccggaggaggttgcacagtgcaagggttcgtataccggacagtatctcggacccatcctcgcccgcaaaaacggcggaaaacgcgaacaataaaacagcaaatcaaagcgggcactccgacaaggagcgcccgcttgttctctttccatagagaacaaagcgaaaaaattatgcctcgcgcgacagcgcgcattcaatcggatttgcgtagcaaatccataaaaaggcggggcgtgtacctgcctttttatacaagggacgaaaaattgtgcccgtcagggcgcggcttttcgtcgaaattcgctcgaaagcgtggtttcgagcgagaagctgttcccaaaacgatcgttttgggaacagcttcaaaaatgttgtgattttgggcgtgttttggtataatagtgataatataaaatcggagttaccatacgcagacgccggaaggcgtgctgctgccgtgactcaggaagggatcgttcaatatgagagcaaagcgatgggtgatcgcctcgccggacaccgagcgggtgcgggtgctgtcgcaggagaccggctatacaccgctgacggcggcggtgctgacggcgcgcggcatcgacacaccgcaggctgcggcggattacctgagctgcgatgtgcgcggactgcatgatccgttcggtctgaccgatatggataaggcagtcgaggtcgtccgcgaggtaatagatcgcggagaaaaaatggtggtctacggtgattacgacgtggacggcatcacggcaacgtgcacactggtggattatctgcgcagcaagggcgcaaaatgtgaatattacattcccaaccgtttgacggacggctacggtctgacccgtccggcgatggagcagctgtatgagcagggcacgcgcctgctcatcacggtggactcgggcattacagccaacgaggagattgccgtcgcacgcgagctcggcatgcaggtcgtcattaccgaccatcacgagtgccacgaaaacctgccggacgcgcaggcggtcgtggactgcaagcggacggacgatacctatccgttttccagtcttgcgggtgtcggtgtggcattcaagctgatctgcgcactcgagggcgacacgctttccatgctcgaccggtacgccgaccttgtagcgctcggcacggtggccgatgtcatgccgattgtcggtgaaaaccgcattatcgtggcggaagggctgaaaaagctgtccgtgacggcgaatatcggtctggagatgctgctgcgcgaggcggggatgaagaacaggcggctgacctcctcgaccatcagctatgtgcttgcgccgcgcatcaacgcggcgggccgcatgggaaaggctgagctggcagcagagctgttcctgacgaaggacccggtacgggcacaggcgcttgccgctgagctttgcgagcaaaacaagctgcgccagaacgaggagaacaagatactcgagcagacgctcacgcgtttgcgccgggaatacaacccgcttgaggataagatcatcgtgctggccggagagggctggcatcagggcgttatcggcatcgtgtgctcgcggctgtgcgaccgctacggctgtccggtcgtgctcatctcagtggatgaggacggcgtaggcaagggctccggccgctcgatcggcagcttcaatctgtttgaggcgctcacctcgtgcgaggatttgttcgagcgctacggcggtcatgcgcttgccgcaggactgaccgtgcaggcggacaggatcgaagaactccgcacgcgcctgcgcaagtacgcggaaacgcatgtcaccatggcggagctcgttccgcagctgcacatcgactgcatggtgcagtcggagtggctgacgcaggagaacatcgaatccctgagcgtactcgagccgtacggcatgaaaaatgcggagcctgtgttctgcatgaagaacatgaccgttgaggagattacgccgctgtccagcgaccggcatgttcgtctgtcgctcatcaaggacggcaagcggttttccgcgatctggttcggcatcggtgcgggcggtctcggctttgtcgaaggcaacaccgtggatgccgcctttcatctggagatcaacgaatttcgaggccgccgctcggtgcagctgaccatctgcgatgtgcagctgagtgactgtgagcatctggcggatcagaagattctcaatctgtataatacactcatgcaggacggcccgctcaccgcaagggaagcgcgtctgctcctgcccgaccgcaaggatctggtcgctgtctggcggcatgtgacctgccgcgcggaggacggacggctttccgtaccggacggggcgctttcccgccgggttgcgtgggaaagccgacgcgacattaacatcggcaagctgtttgtctgtctggacgtttttcaggagtccggactcatcagctatcatttcaaggaaggcatgctcaacattttgctcaaaccctacgagggcaaggccgatatttccggatcggttgtccttgccacattgcaaagcatggcggggtgacacgaatgggggaagaatctatgcaaacgaaactggattttttgatcgaacgcgtacaaaaacaaaacccgcaggcgaatatcaagaagattcgcgcggcatacgaatgtgcggccaaggcacatgagggacagaagcgccgcaacggtgagccgtatatcattcatccggtcgctgtcgccgagatcgttgtggagatggggctggatacggattccatctgtgcagcgctgctgcatgactgcattgaggacaccgagttcggctacaaggagatcgaaaacaaattcggcacgccggtcgcggagctggtggacggcgtaacccgactgggtatgctgcgctactccaaggagcaggagcagttcgaggacctgcgcaagatgttcctcgccatggcgaaggatatccgcgttatcctgatcaagctggccgaccgactgcacaatgcccgtaccttccagttcctgcctgagcgcaagcagcgcgacaaggcactggaaaccatggagatttacgcgccgatcgcgcaccgtctcggcatgagccgcatcaagtgggagcttgaggatctgtcgctgaaggttctcgaccccatcggctacaacgagattgtggaaggcttaaaggcccagagtgagcagcacgaggaattcctgcagggcattcaggaccgcatcagcaccaagctgaaggaagcgaacatccacaacgcgatttcggcccgcgtcaagcatatttactcgatttaccgcaaaatgtatgcccagcacaagaccatcaacgagatctatgatatctgcgccgtgcgcgtcattgtcgataccgtggcggactgctacaacgtgctcggctacgtccacgacctgtacaagccgattccgggccgcttcaaggactatatctccacaccgaagccgaacggctatcagtcgctgcatacgacggtcatcggtcgagcgggcatcccgtttgaggtgcagattcgtaccgtagagatgcataaaatggcggaatacggtgttgcggcgcactggaagtacaagcagggtctggacaagaagggcaatgaggaagcgttcgcgtggattcgccagctgcttgaagcccagcaggacaccgaggccgaggactttatcaaaaacatcaaggttgacctgttcgcggacgaggtattcgtctttacgcccaagggcgatgtggtcaatatgccggcaggtgcaacgccgatcgaccttgcgtatgcgattcactccgcagtcggcaaccgcatgaccggctgtaagctgaacggccgtatcgcaccgatcgacagtcagctgaaaaacggcgatatcgttgagatcctgacctccaaggaggcacacggtccgagccgtgactgggtgaagatcgtcaagaccaccgaggcgcgcaacaagatcaagcagtggttcaagaaggaatgccgcgaggaaaatatcgtcaacggcaaggaggatctcgaccgcgagctgcgtgccaacctgctgtataacggcttctatgagaacgaagaggtgcagaagaacacgctcaacaagttctcgttcaacacagtcgatgagctgtacgcggccatcggctacggcggcattatgctgaccaaggtcatcaataaggtcaaggacgatgtcggcaagctgcgccgtcagcgcgagcaggccgagcgtgccgcgcatccgcagaacgagcagcagcagcgccgccagaataaatccagcgacggtgttgttgtcgaaggcattgataactgtctggtcaagtttgcgcgctgctgtacgccgattccgggcgatgagatcgtcggctttgtcacccgcggctacggtgtttccatccatcgccgcgactgcgtgaatgtccatatcgaggaagagcccgaccgctgggtacgtgcctggtgggatgaggatatggcagccaatgccggtcacgtcaataagttctccaccggtctgcagatttccacgcgcaaccgtatcggcgtgctgagtgacgttacgctggcgtttgcatcgagtaagatcaacgtgcatgagatttccgcacgcgacctcaatgacggctacggcgttatcaacgccatggttgacgtcacgagcgtccatcagctggataatatgatcagccgcctgcgttccatcaagggcgtcgtggatgtcacccgaacggttgatacgaattgataattgatgattgagaatggaaaatgagacgcggaaagcgcttgtgcctgcgcgtttcaggctcccctaaaaggggaggcattggctggtgcagaaggtttacaaaggctcgatgggtcatcgagccccacgatgtatctaactggtatcatcaaaggagttgcgcggcactgctatgccgcgcccaacgtagaccccaattggatgtagcagtacggtatccgaaatgcgaataagtggataccgtgcggaagaaaaaatcctctgccgttcctttcctgcttgcgaagtctaccatctgcactcaaggtatcccaaaaaggaaacgggagtcccaagagggtagaaaccattggtgtctacccttttggaaccccagccaaggtttggcactcattccaaatcaaaaaaatcaacagattaaattcaaaacttactacgaaaagaggaaaaacaatgcgggcactggttcagcgcgtctcccacgcctcggtcacgatcgacggcaggattcacgggcagatcggacagggcttccttgtcctgctcggcatcacagacggtgataccgtggacgatgcggtttatctggccgataaaacagttaaaatgcgtgtattcacggacgaaaacgacaaaatgaaccgctcactcgcggatgtcggcggcggtctgctcatcgtgtcgcagttcacgctctacggcgactgccgcaagggcaaccgcccgagcttcacgagcgctgcccgtccggagaccgccatcccgctgtatgaagcattcattgcgcgctgccgcgagagtggcctgccggtcgagaccggtgagttcggcgcggatatgaaggtcgatctattgaatgacggcccggtaacgctgtggatggacactaaggatatgcggcattgacaagataaacctgttccgtaggacggggcactccagagtggcttctcttgcctatcggcaattcaccttctgccctcaccctgcgaaataaaacaatttacactgacttaccacggcgggctgagggcagcccgcccgacgaagaaggcttaaatgccgaagaaagggtataactaatgaagttgatgcaactctgtgtgggcatggtccgcacgaattgttacattgtatatgacgaagcaacccgcgaagccgcggtgatcgatccgggcgacaatgccaagtcgattttgaacgcggtaaacgaggaacggctgaatgtcaagtatgtgctgctgacgcacgcgcattttgaccacattttggcggcgcacgaggtgctcgaagcgaccggcgcacagtatgttgtgccggagaaggacatctggctgctgagccgtgacaacatgggtcagttccgcggactggcacgcaattatgtgcaggatacgccggatattctggcgaatgagggcaccgaggtgacgttcggcggcatgaccgcgacctacatggcaacgcccggtcacacacccggctcgtccgtcatcaggatcggcgactgcctgttcaccggcgatacgctgttccgccacgagtgcggccgctgcgaccttgagggcggcgatttctctgccatgctgcgctctttgaagcgtctgcatgacattgacggcgattacaaggtattccccggccatgagggcatttctacgctgaacgaggaacgcgcatacaatccatatatgctgcaggcgatgggaaaatgatctatacactggaaaatcacgaactgaaacacgcggtagaggaaatgctgtttcatctgctgccgaccgaaacgttatccaaggcggataccgccgagcagctcaccgagccgtactgccgcagcattttgaccgaggagaacggcgaagccgccgcgcgtgcgatcgtctgcatggacggcgcagtgcatgaggcggaaaagcgcgcgtccgttaccggactggcaacgctggaccacaagcgcaccatcaccgaactggtgaaaacgaccgtgtacgatgcagtcgtgccgttcctgccgcaggctccggtctggggcagcctgaccggcgtgcgtccggccaagctggcgcgcggcatgatcgagcgcggcatgacgcgcggcgaggcggcggtcgagctgcgcgagcactttcacgtttcgcctgagcgcacggcgctgacgattcgtgcagccgcaaccgcgatggagatggacaagaccatcggtgaaaacgatatttcgctgtacgtcggtattccgttctgtccgtcgaggtgctattactgctcgttcgtatcggcaaccacggcgcagtccggtaaactcatcgagccatatctggacacgctctgccgcgagatcgaggagacagccgcgcttgtccgcgcagcaggcaagcaggtgcagagcgtctacatcggcggcggcacaccgaccacgctggacgagcatcagctggcacggctgctgtcggcgctcgaaaatcactttgatttttcacatttgcgcgaatatactgtggaagcgggccgtccggataccatcacaccggaaaagctgcgcgtgctcaaaagcgcgggcgttggccgcgtgagcatcaacccgcagagcatgaatgacgccgttctggctgcaatcggcagaaaacacggctcggcagacgtgctccgcgcgtttgacgaggcgcggcaggcgggctttgacgagatcaacatggatctgatcgccggtctgaccggcgacaccgccgaaacttttgcacagactgtggatactttgctgaatctttcgccggagaatatcacggtgcatacgctcgccatcaagcgcggcgctgatctgaccgataaggcggctgccgccgcacagcgcgagacggtttctcaaatgctggatggagcatcacacgcgctgcagaacgcaggctacggtccgtattatctttaccggcagaaatttatggcaggcggctttgagaacgtcggctggtgcaagccgggcaccgaatgcttctacaacgtgagcatgatggaggagctgcagaccattctgtcgctcggtgcgggcggtgtttccaagcgcgtcgtgcgcgagaccggctggattgagcgcgcgaacaatccgaaatatccgcttgagtacattcaggcggcagacagactggccaacggcaagaaaaagctgctgttccccaagaaataatcaggatagggaaatgagtgagtaattccgtaagaagggactgtctatggcagaatacacactgaaatacatcaatcaccgcgccgaatgcgacgcggaagcctttgtgaacgactgcgaggagcactatcatcgtcagctgcatctggtggctgaccagatcgccgcgaactgcaagcgcaagccggtcgtgctgctcaacggcccgtcctcatcgggcaagaccaccacgaacgaccgtctgggccgcattctcgagctggcgggcattcacgcgcatatgatctcgatggacgactattaccgtacctcgggcacctacgacattccgtttgacgaggaaaacggcgtcaatgacctcgaaagtccggagtgcatggatctggatctgctccgcgaccacctgacacgtctggtggcgggcgaggagatcatggtgccgcgctttgattttgaaacgcgcacctcgcatcgcaacgagcgtgcggtgcagctgcacaaggacgaaattgtgatgatcgagggcatccatgcgttcaatccggtcatcatgggcgatctggagaaacatgcgacaagcgtctatctttcggtagcgagcgtgctgctgaccgaccataacatccgcgttgagccacacatgctgcgtttcctgcgccgcgccatgcgcgacagcctgttccgcagctcgccggtggagcacactttaaagcagtggaactcggtgcggagaggcgagagactgtatatttcgccgtaccgcgggcaggctgaccttacggtggacacctatctgccgtacgagaccaacatcctcatgcagtacctgagcgaaaagctgcagggcgaggagaaaatgctcgagcaggctgaccttgcaccgctcagcgcgattttgaataaggtttcgccaatcgactacaagccgtatatgccggaggattcggttctgcatgagtttatcggctgaaaagtgtccggattcttgctttttggcagggtatgaagtataatggcaatactacataattgaaactgcggcgttttgcggaaatttttccgcaaatcgtccttgttccattacgcaatattaccatgagaccggaaacggagacattccgtcggaaggagcgacaatctatggatatgaaaatgcaggcttttctggataaggtaaaggacatggcggataaaaccggcaaggtctcccgtcatgcggcaggcgtagccggcaaaaaggcgaacgaccttgcactggcgacccgcatcaacctgcagattttcgatctgaacaccgagtgcgaagcactgtacaaggaaatcggcaagctggtgtacgatctgcaccgcggcgcagaggtcaccaacgaggaaatggacgaaaagatggcgcaggtcgatgccaagcaggaaaagctggctgtgctgcgcgacaagctggcggaaatgcgctcggtaacggcgtgcccgcactgcggcaaaccgtgcggcaaggatgacgcatactgctcgtcctgcggcgcagagctgtaacataatacggtttgatgcatcatattgtaatatcgggcaagggcagctatgcccattctgatcaaaggaaggggcgtacggcgtttgcagcgtaaaaaacagaatttcattcaaggtgcgttcattttgatgctggccagtctgcttgtcaaggtgattggcgcattcttccagataccgctgctcaacatgatcggcggcaaggattcgccggcgttcggcatgttcagtgcggcgtaccgcgtgtacacggcgatgctgatgatctcgaccgtcggtgttccggcggcgctggcgaaaatggtcgcggaggccacagcccgcggcagagagcatgaggtgcggcgtaccgtccgtgtggcgggaagcattttcattccgctcggtgcagtctgctcggtcgtgctgttcctcggcgcgggcacgtttgcatcctggatcaagagcgcggattcccggctagcggttatggcaatcgcaccgagcgtgctgatggttgctgttctggcggtgttccgcggctactatcagggccgctcgaacatggtgccgacggcggtttcgcaggtgatcgagtcactcggcaagctgtttatcggtcttggactggcgtattatgcggttcagcataacttttccgatcaggcagtcgcggcaatgaccgtcctcggcgttaccatcggcgaggtggctgccgctgtttacatgctcattcagggagcgatcacgcatcgcagcagctcggcagtgcatgcgctggacgacagcgtgcgtccggcgggccagctggcgaaaacgctgctcagtctgtccattccgatcacgatcagctcagcggttatgagtctgaccgacctgatcgacgtggcgctgatctctacgcgtctgcaaagtccggcggtcggcatgacggcaagagaagcgatgtccacctacggcatttacaccggtcaggccatcaacttcttcaacctgccgcagacgctcatcaccgcactggcggtcagcgtgctgccgaccatcgcaagcgcatgcgcggcgggcaaccatgccaaggtctctaaaacactgggtaccacgctgcgcatgacggttatcatcaccctgccggctggcgcgggcttcatcatgctcgccggaccgattctgcgcatgctgtactcgcagggaacggagcttggcggtgtgctgatgggtctgctcggatttgccgtaccggcggcggcacttgtggctgtcaccaactcgacgctgcaggcgttcggccgcattgacctgccgcttgtctcgatgtttgcgggcgcggttgtcaaaatgctcggcgactattttctcatcggcaatccggcgctgaatatcatgggtgcgcccatcagtacggcgctctgctactggctgatcgcggtcatcaacctgttccacatcaggcgtctgacgggttcgctgccgccgatcggaaaaacggtctgccgtccactggcggccaccatcggcatgagtgcggcgattttcattgtgcagcgcgtgctgaacggtgcgttgagcgcagctcccggcaccatgcctgacaagctgatcacgctcgcgtgcatcggtgtggcggttgccgtgtatgccgttctgctgctcgcgctcggtgcagtcgagcgggatgatgttctgctgctgcccaagggcgagaaaatcgcagatattttacatctaaagtaatcaggaagtgcaaaaatggttgattttgaaataaaggattgttacaagttcgatgatctgctccgcattatggaaatcctgcgcgcgccggacggctgcatgtgggaccgtgagcaggatcatcattctatccgccgcaacttcatcgaggagacctacgaggtctgtgaagccatcgacgacgaggacaccgagcatatgaaggaagagcttggcgatgttctgctgcaggtggtattccacacccagatggagaaggaaaagggcacattcgacatcgacgatgtggcggacggcatctgcaaaaagctgatcttccgtcacccgcatatcttcggcaatgtcgaggtcgcctcgtccgaggaggtcctcaggaactgggatgacctcaagcgcaaggagaagcatcaggagaccgatacgcaggcgctcgaaagcgtagcaaagagcctgccgagtctgatccgtgcagaaaagctgcagaagaaggcggcaaaggtcggctttgactgggataacgtgaaggatgcacttgacaaggtgcaggaggagcttgacgaggtccgccgtgccatcgacggtgacggcgatccggaggaggagattggcgacctgctgttcgcgtccgtcaacgtggcgcgtcacctgaagatcgacccggaggctgctgccgaaaagacctgcaacaagtttgtcagccgctttgcggagatggagcgtcaggcgactgccgcaggcaaaaagctggctgacctgtccctttccgagctggatgcactgtgggacagcgcaaagcacgaggaacatgcataaggagcaaaaccatgaagaaaagcgaactggtgacgctggttgcagaaaagaccggcttttccaagaaggacaccgaaaagacgatcgacaccgtgtttaccgccattgcggatatcatggcggccggtgacaagctgcagatcagcggcttcggtacgtttgagaccaaggagcgcgcagcacgcacgggacacaatccgcgtaccggcgaggagatcaatattgcagcggccactatgccggtgttcaagccgggcaaagttttgaaggataaggtagacggaaacaagtgagattagacaagtatttgaaggtatcccgcctgatcaagcgccgcacggtggcgaatgatgcatgcgatgcagcgcgcatcacggtcaacggcaagtcggccaaggcttcgtatcaggtgaagatcggcgacgtgatcgagatcgcattcggtcagcgcacgatgaaggtggaagtgctgaatatcgcggagcatacgctcaaagcagatgcgtctgcgctgtataaggaactgtaaacccaacataacgtatcccactctcgcatatattgcagagtgggatacttttttgcagtcaggaggggagttatatggcgcaggaggaacgaagccgtgaaatgccgcacagtgtcattctggaggggagagagaagctgaccatttccggtgtgaccgatgtgcacagctttgatgaggaacaggtgctgctcgaaaccgtgcggggcatgctggtcgtgcgcggtcagggactgcatgtagagcggctgcagctcgaggccggagagctgatcattcagggggagatcggcctgctcgagtacgacgacagcgtgcagccgcgcgacagtctgtttcggcggatattcggcgggtgagcggccatgccggtgtttacaaacagccagcaggtcacgctcgtgctgcaaagcctgctgctcggtgtcgggatcggggcggtgtatgacatgctgcgggcactgcgtctgcatttccggtgcggatgggcaggggcggcgctgctcgatacgctgttctgggcgatcgtgctggcggccttattcgagttcgggctgatcgcggccgccggtcagccgcgcggctttgtgcttttaacggcggcaggcggcatgggattgtactttgcgacgctgagcgaaaccgtgctggaggcgattatgcggcttctgcaggtgcttgcaaagctgagacgcgccgtatacggcctgcggatgcactgtcaaacggtggtaaaacagcggtgcagtccggtaaaaattcggtttttgacgaaaaaatttgaaaaagactcttttctttttcgcaaaaaaggtataaaataaaacctgtatcagtctgacgcgcaagcaaacgatatgaggtgagcagatgacaaggcgcacgcggatgatccttatcagggcagcggtagtggtgtttctgctttacgcggtcgtcaatgtggtaaacctgcgcacgcagatcaagagcaagcgggatgaactcgcgtctctgaccctgcgggtggaggaatatcagaaggcgaacgagacgctccggcaggaaatgcaaagcggcatttccgaggaggatatcggagagatggcgcggacagaactgggctatgcggaaccgggcgagcgtatttttgtagatacgtccagccggtaaaagggaaataataacggaggcaaaacagcttatatggatttggcagtgggagcaatcgtagagggcaaggtaaccggcatcaccaagtttggtgcattcgttgcgctgcccgaaggcaagtcgggtatggtgcacatttcggaggtcgcttcgacttttgtaaacgacatcaaggatttcctgcaggagggccagcaggtcaaggtaaagatcatcaatattgatcaggcaggccgtatcaatctttcgatcaagaaggcgcagccgcaggagccgcgtcagccgagacaggagcgccgtgagggcggctttgcgccgcgtcagccgcgtttccagcgttcgtccgcaccgcgcggacgtgtgcagcaggcaccgaaggacccgtccacgatgagctttgaggataagctgaaggcgtttatgtcggacagcgaaagccgtcaggccgatgtgcgccacgcaaccgatcgcaagaacggttcgcgccgccgcagataaagaagaaaaccgagggaaacctcggttttgcttttatatgccggtgcacgaagcgtcggcagggctttttggcaccggctgtccggtgcatacgaggcgcgtatgcgctgcgctcggtctgggcagcacctttctcggcactgggtgagcggggcatacgaactgcgtaagcgtgttcgcccctaacgggcgggaagtttttcgctgaacctcagcgggggcgacgccgtacccacggcggtgggcaaaaaggaaggacaacctgcggttttccttcctctttgaactcctacctttcccttgcttcctaatccggcgcagatttcctatatgtgaccgcttcgaaaatagggaacggcagtcgggttactgcagagtgactttcttcgccttttcgcagttcacagacagcgtactgctacacaggtgggttcatctaagcaggcgcgacataacagtgtcgcgcaactctttaacgcgttataccgcatggcacctgcgaattaggcgtttggtacaatttatcttcgtaggtgctatctatcataacgcgcttacgatttgcgcggcactgctatgccgcgctctgcgcagagtaaatcgcctgtgtagcagaacagtatccggcactgcgaacaggttgcgaaagacacggaagaaaaaatcctctgccgttccccttttcgcagcggtcacatgtcggcaagctgcgtcagaccctcccaaaaggaagtgggagttaagagggtagaaaccttggtgtctaccctcttgcccccgccgcggggcgcggcgcactccagctgaggttcagcgaaaaacccaccgtccgttaggggcgaaccgcctgcgcggttcgtgtgcaccagacaattggtgcaggaaaaggtgctgcccggacagggcatattgctgcgcaactcgcgtgcccagcatactttgtgctgaaaaagaagcgcaactcctgcttttgcgcaaaaaaagcgcgctcttccttgcgaaagagcgccaaaagtaggattgtggggataaagatatgaacggtgcatggcggctttcccaaccgccatgataaatataccataaattaccatatatgtcaatagcttttttgaaagaggttctgaatgaatcaaacactgatcgaaaatgtaaacatttggacaatggacgaggaggatacccgcttttacggctgggtgctgctcgaaaacggcaaaatcgcgtccatgggcgaaggcgaaccgcctgcaatgccggttcaaatagacggtgatgtcgtgtacggcgagggcggcgtgctgacacccggcctgatcgacatccattcgcacatcggtctgtacgaggacggtctcggctttgagggcgcggacggcaacgaggacaccgatccggcgacgccgcatctgcgtgcactggacggcgtcaacccgttcgaccgcagcttccgcgaggcacttgaggccggtgtgacggctgcggctgtcagcccgggcagtgccaatcccatcggcggacagattgccctgctcaagacggcaggccgccgtgtggacgatatgattctcaaggcgccgctggcgatcaagttcgcgctgggcgagaacccgaagtcggtctaccacgacaaggacgaaacgcccgtcacgcgcatggcaaccgcgggcatcatccgcgaggagctgtacaaggcgaaggagtatttcttgcgcaaggcgcgtgcggaggacgatccggagcaggacgagccggatttcgacatcaagatggaagcgctgcagccgcttctctggggcaaggccgaggcacattttcacgcgcaccgtgcggacgatatctttaccgcgctgcgtatcgcgaaagagttcggactgcgcgccgtcatcattcacggcacagaggcgcatcttgtggccgacctgctggccgaggagcacgttccggtggtcagcggcccgtatatgactgatcgctccaagccggagattcgcaacctgtcggatgccgcgcccggactgctgtgcaaggccgggatcgaaaccgccattacggtcgatcacccggaaattccgctgcggttgctgccgatggcgcttatgctggcggtgcgtgcgggtatggataaaacggacgcgctgcgcgcggtcacatcggtacccgcgaaaattgcgggcatgcaggacagaatcggcagcctgaaaaccggtctggatgccgactgtgtgctgtggagcggcgatccgctggatattgcaacccaggtgcaggctgtttttgtaaacggcacaccggaatataggaggacaaaatgaggacgattgaggtttcggaagtaaccaagctggtgcgtcagctgtgcattgacgccaactactatctgcccgcagatctgcggcaggcgttcgtggatggtcagaacgcggaggagtctccgctcggcaagaccattttcggtgaaatgatcgccaactgcgaccttgcacgcgagaacaacgtaccggtctgccaggatacgggcatggcgatcgtgttcgcggagatcggtcaggacgtgcatctgaccggcggctcgttcgaggatgcagtcaccgagggtgttcgccgcggctatatcgacggttatctgcgcctgtcggtggtcggtgatccgctgcgccgcgaaaacaccaacgacaacacgccgtgtatcctgtacacctcggtcgttccgggtgacaaggtgaagatcacggttgcccccaagggcttcggatcggagaatatgacccagatgaagatgttcacgcctgccgctaccaaggcgcagatcgtggattttatcgcggatgcgtgcatccatgcgggttccaacccgtgcccgccgatcgttatcggcgtcggtctgggcggcacgagcgataaggcggcatatctcgccaagcgtgcgctgctgcgtccggtcgatcagcacaacgccgatccgctgtacgccgagatggagcagcagattctcgataaggtcaacgcatccggtgtcggcccgcagggactcggcggtacggttaccgctcttgcgtgcgcgattgagccgtttggcacgcatatcgccggtctgccgtgcgtggttaatatttcctgccacgttacccgtcacgcagagggcgagctgtaagcaaccttgacaagaaattgtaaaacctcttgggaaatatgctgaacaaattgtgaacttctgaaaaattgttggacaagttgcataggttgtgctatactgaagatagcaaaaacccaataccgtttccgtcacaccacggcggccgcggataaagccatcaaaggcggtttacgcctgttaggagatgattttatgaagttcactatcgtcgaaagaaaaatcaagatcgaggacgagctgcgtcagtacgcactgcgtaaggtagagaagctggatcgctacttccagcaggattcggataccacgattacattcagcgagctgcgcggcaagcagacggtcgagatcacggtgcgtcaggttggtctggttgtccgcgccgaggaaacgacgactgatatgtatgcttccgtagacggtgccatcagcagtatcgagcgccagattcgcaagcataagacccgtctggagaagcgcctgcgtgagggtgcattcgacaagatggcagagcagaaggccgcactgaccgaggaggatttcgatgtagtacgccgcaagcgcttcgacgtaaagccgatgagcgtggacgaggctatcctgcagatgaacctgcttgaccaccagttctacttcttccgcaacgccgacaacgacaatatccacgccgttgtttacaagcgtgcggcaggcggttacggtctgatcgagggcgaggagtaaaatccgcgtcaaacagtaaaaagttgcattacatagggaccggcggcgttctgccgccggttcttttcggttaaaaggggaaaacgaatgaatttatgtgatattgagacaatccgagcagttctgggccgtcacggattccatttttccaaatcgctcggacagaactttctgacggacgaaagcgtgccgcgccgcattgcggagatgagcggcgcggccgagtgcggcaacgcgattgaggtcggcccgggcatgggctgcctgtcggcggagctgtgccggcgcgcggataaggtcgtagcggtcgagctggaccgtgccctcatgccggttctggcagagacacttgcggattacgataacttcgaggtcgtgcacggcgatgtgctcgaaaccgaccttgcggcgctctgcaaggagaaattcggtgacggaaaggcgatcgcgtgtgccaatctgccgtattacatcaccacaccggcgattacggcgctgctcgagagcggcgcgttcgagcaggtgacggtcatggtgcagaaggaggtcgcgcagcgcatctgtgcagagccgggcacggcggcgtattcggcgttctcgatttatgtgcagtaccacgccaaggcggaaattttgtttgatgttccggcggactgctttgtgcccagacccaaggtggattcggcggtgctcaagctcgtgccgctcgacaagccggcggttgagactaaggacgaaaagctgttcttttccctcgtgcgcgcagccttcaatatgcgtagaaagacgctcgtgaacgcgctcggtccggtgctcggctcgtcgatgagcaaggaggagatcaccgcactcgtagaagcagccggtctggatgcccgtgttcgcggtgagcggctcagccttgcagagtatgcgaaactggcagatctcgcggcggaaaaactcagtaattgagaattgaaaatggagaatggaaaatgtatctgatgttttgcattctccatttgttcatttttcatggcgccaatcggatagacggcggggcaccccagggtggcctctcttgcccttcggacaattcaccttctgagggcatcccgccctacggtagtggctaaacatgtttcgtagggtgggctgccctcagcccgccgtttgtcaactcatttgcagacatataatcgtaggggcgcacagtgtgcgcccacattatcgttaaatgggtaggggagcacactgtgctcccctacggcataatctgtggaatcatttggagaaaatgtcgttgcgttaattttccattttcaattctccattctcaattttaaaatcctgtggacaaaagaaaaagcctgcacacgcaggctttttctcataccacaatggctctcggcggcaccggcgaggaaaacacgatctgtgtttcggtcttgccgaatttttgcagacgtccgataaagccgtccagctcctgcgtcgaggcgaacgacaccttgatcagcatggagtagttgccggtcacgcagttgcactcgagcacattcgagcacgcagcgatgaacggataaaattcctctttctgggtgggctgcatatccagatgaatgtacgcgagaatgtgatggccaagctgcagcgggtccagatcgagcgtatacgcacgaataacaccctgtttttccagccgctcaatacgcgcggaaaccgcaggggaggaaaggcgaacctcacctgcaagggccttgatgggggtgcgggcattcttctgcagcagccgcaagagcttcagatcaatttcgtccatggggcaaatagccctccttatcctaaaaataaaaacaggagtccgacccgccttcgcgggacgaactcctttgttcactgtttattataaagcacgaccgggttgttgtcaaataaaataaggcttcgaacaaaagtttttatacatccgagtcggtgatgaccttgaattccatccagtccggcgttgcggaaacgtaaatggtatcctcgtcaatgaacacaaaatcccggttatcgctgaaattggactggttgttttcggtcggaacatcgtttcggtttgccgttttcgaggtgatcgaaccgtcaggcgttccgcagaacggctcggaaggcaggtttccggtctcctgatacagcttgccatccaccatgaccatccgcggtacggtggcatcctgctcgaacacgatccactggttatcaatcagcacctcgatatggtcgtctatgcgctgatagccgtagcctgtgccgaagttggactggccgttctcggtgggcgcgtctgtgccgttcgccgtctgcgaggtgatctcgccgtccatgttgccgcagcggccatcgaccgtgctgacctcaccggtagattgatacagcgtgttatccaccatcaccatcatgggtgcatctgcgaccggtttctgctcggtggtatccggcagggcagctgcgtcatccgtgctctgtgcgccgacctcggattccgcggttttcggctcggcattgccgcagccggtcagcagcagcgccagaagtgcaagaagcattgctaaagtacgttttgtcataaaaaaacaccgcctttcgtaactctgatagtatagacgaaagacggcgtaaaaagttccgtataaaattattttttctttttcggttttgcccagccggatttctttccctgtgtcggcttggtctgtgccgggcgcgatgcaggacgcttgccgttcggcgcactgcgcttgccgttattgggagcagaatgacggcggtcgctgttctgctgcctgccgccgttggacacgccgtggcggctgacgctgtgctgcttgctgcccggcatgcgctggtcgctgcctctgcccggacgaatgagacattccctgccaaagccgatgagatcctcgcggtgcgcctttttgagcgcggcaatgacgatcgggcgtttgtccggtcggcgccactgcagcagcgcacgctgcatggccttgtcctcgggcgtttttgccacgaaaaccggcttcatggtgcgcggatcaatctcggtgtagtacatcgcggtggacagcgtacccggcgtgggataaaaatcctgcacctgctcgggcatgtagccgacgcggttgaggtactgcgcgagcatgatggcgtcatcaagcgttgcacccggatgcgagctcatcagatagggcacaagatactgcttgcggcccagcttttcgttgatgcgggcataccgctcgcggaactgctcgtacaccttgaaggacggcttgcccatgtagtacagggcgttgtcgctcatgtgctccggcgcgaccttgagctgaccggagatgtggtgctcgaccagttcgcggaagaacgcatcgttcttctcggccatcatgtagtcgtagcgcagaccggagcgcacgaacaccttcttcacgccctcgatgtggcgcagctcgcgcagcagctcaaggtagtcggtgtggtcggcctcgatgttctgacaggtggtggggaacaggcagcgcttgtccttgcagcagccgtatttctcctgctttttgcaggccggaaagcggaaattcgcggtcgggccgccgacatcgtggatatagcccttgaatccgggcatttgggtgatcttttttgcttcctcgatcacgctctcgtggctgcgcacctgaatgtagcgtccctgatggaacgcgagcgcgcagaagttgcacgcgccgaagcagccgcggttgtggatgatggagaactgcacctcctgaatggcaggtacgccgccgagcgcctcatacgacggatgatagttacgcatgtacggcagcgcgtaaacatggtccatctcctctgtggtcagcggctttgcgggtgggttctgcacaaggatgcgcttgccgtgccgctggaggatggccttgccgcgcacggcatcctgttcgtcgtactggattttgaccgaacgggcgtagtccggcttgctggcgcagacatcctcgtacgagggacattcgaccgcatcatactccagatcgtccgtatcatgcaccatataggccgtgccgcggactcccttgcacgcgtccgcgccctttttgccgtgcttgaggttgtttgccagctcaacgaccgagtgctcgctcatgccgaacatcacaccgtccgcgccggtggattccagaatggacggcataacacggtcagcccagtaatcgtagtgcgcaaatcggcgcagactggcttcaatgccgccgagatagaccggcgtttccggaaaggcgcgccgcgcaagcatggaatagacggttaccgcacggtccgggcgcttgccgcccacaccgcccggcgtgtacgcatcgtccgagcggcgctttttcgccgaggtgtagtgcgcgaccatcgagtcgatgttgccgccgttgatgagcaccgcatagcgcggacggcccatttcgagaaaatcgtgctcatcgtggaaatccggctggctgaggatagcgaccttgtagcctgcatcctccagcacgcgtgaaatgatcgccgtgccgaacgacggatgatcgacgtacgcatcgccggtgacgatgagaaaatcgcagtaataccatccgcgatcggtcatatcttgtttggaaatagggagaaaaccgttcatatatacctctttggctttacaaggtgaaaattataggttacaataaaaatacgggtaatccggcaaaagatgttgaagacggttgaccatactccctgaagggaggtggtattatggatcagatttggcagatcattatgttacttattctgctcgagtttgtaaaaaccataaaaaaataaccgccctcgccaaagatgcggttattttttcgtgaataactaaactttggtcaaccgtctttcgccggattgcccttttctatctataagtatagcaaatctgcggtaaaagtcaagccgcagagcacggaatgttttgtaaaataaaaaaataaccgccctcgccaaaggtaacggttattttttcgcaaataaggtatacggttattctgcaaaaactcagttatccagatagaactgaaccagctcctgcatgagttcgtcgcggtcgatcttgcagatcaggctgcgggcattgttgtggttggttatgtaagtcgggtcctcagagagaagatagccgacgatctggttgatcgggttgtagcctttctccttgagcgcatcatacacagtggtaagcgtgcgcttcatctccttgttggactcgtctaccagactgaattttctcgttccgtcaagcatatttggttctcctttccgatcctacctgtcggtgtttatcgttacttacagcataatacaaaaagcagaaaaagtaaagccttatccgcgcaaaactcgcatgaaaactttttccgcctgtggcatacactgtatggtgagggaaaaggagacggtgttttacgagctgtaattttccagcagccgcgccagctcctctgcgttatcgagcgtaatgccgtccgcaagtgcctgctgctcggcggatggcagcgtgcgtgtgtcgatgcctgtgcgcaggaccgagccatcgctctgccggatgacaagccggtcattttcgctctgcaccgtgtaactaattgctgcgctcgccggaacggcaggcgcggacagcagcgcgcgtccggccagcacaatgctgatgagcgccgcgatacacgccagcgcggcaagcagcgtgcgccgccgcgcctgctgcatggcaagcagataaaaaccctgcatcatagtcaaaactccttcactcagtgggacttgctttgagtattcccacaaaaatacggtctattctaaaagcagtgtaaaaaatgtttggaatttgcaaagtcctgtggtataatgctatcagagtgcctattacatcggcagtaagctgccggaagaaaatcggcacaggcagctattgtacaattcatttagccttataagacggtaataccgatgaattttacggtattgccaacaatacacggtgcttcaaaaaaacaagaccgtgtgcgggaacaaataggacgtgttccgcgtcttacccgacaggaccctgcggtgcatatcgtggggcaaggaggaaaacaaattggcaactggcaatcaaaaaggaacggggatcggacatctgctctcccgcatactgattacactggtattgatcggcgtgctgtgcggctgcttctgcggcattgcgtttgcgatgtatgtgcacatctatatcaatccgtccgcgcaggaaactgcggtggagatcagcaagggactgggtctgaatctgaattcattcatctatgctaaggaatcggattccgatgaatacacgctgtacgaaaccatcaagggcaaggaaaaccgtgaatgggtggacagcgacaagattccggataccctcaagaacgcagtcgttgcaatcgaggacgagcgcttttacaagcaccacggtgtagactgggtgcgcacgatcggtgcggtcaagggctggctgctcggcggcacgcagtacggcggctccacgataacgcagcagctgatcaaaaacatcacggctgacaacgattactcggtaaagcgcaaggtaaacgagattttccgcgcgtttgcactcgaaaaagagattgacgacaaggaccgtattctggtcatgtacctgaacacgatctatctgggctacaacagctacggcgtgcagactgcggcgatgcagtactttgacaaggatgtatcgcagctggatctggcagaatccgccgtgctggcaggtctcaccaacaacccgtcgatttacgacgtttataaccatccagaaaaggtaaaggagcgtcaggagaccatccttgcacagatgctcgatcagaagatgatctcgcaggaggagtacgaggctgccgtagcagaggagctgaactaccgcccctacgaggagtatcagcaggagatcaagtccacctacagctacttcaccgatgaagtcatcaaggacgtgatcaacgacctgatgaccgaaaagggatattcccgtctggttgcggagaacatggtttactccggcggtctgaacatctatgcgaccatcgacaccaaggtgcagaatgcactcgatgaggtctgggctaacgcagataatttcccgaacaccgaaaagtacggcgaaattccgcagagcgccatggtcatcacggacaagcagggcgatatcgttggtattgccggcggtcgcggtgaaaagaccagcagccgcggcttctcttacgcgtctgacgcacgccgtcagccgggttcctcgatcaagccgctggcgacctatggtcctgcgatggatgccggtattgctacgccggacaccacggtttacgaccgtgcgctcatacaggatgaggaaggcaatccgtggccgatgaacgacggcaaatatccgaccggccgtgcaatgacggtcaaggaaggtatgacgcgttcgctcaataccatttcggcacagctgctcaaacagctgactccgcagaagtcctacgaattcatgacgcagcagcttggctttaagctggtagacagccgcaccaatgaggacggcaccgtgcagtcggatatcgaccttgcaccgctggcgctcggcgcactgacggacggcgttaccgttcgtgagatggcgggcggtttctcgaccttcatcaatgacggtgtttacggcggtacccgcacctacaccaaggtgacggacagcgaaggcaacaccataatggagaatacccctaacacggataagggctttaccaatgtccgcacggattattatatgctcgattgtctgaagaacgttaccgcacacggtaccgcctacggcattcagcttgacggtgtagaaaccggcggcaagaccggtaccaccacctccaataccgatatctggttctgcggcatcacgccgaagtattccggtgcggtatgggtaggctacgagcataactaccgtctggatggtctgtacggccgcaatgcggcggaaatctggctggccgttatgcagaaggtgcatgcgggtgattccggtctggtattcgattcgcatccgcaggatttcgaggaagtcacctactgtatggataccggtctgctggcatccggtgcgtgccgcgctgcgggacgtgctgcaaccggccgattctggaaggacaaggttccgaccgagacctgcagtcatcagaatatcgaaaacaagtatgatttcgagagcatgggcgtagataattattactacgacgatgaagaagatgacagcgattcggacagcagctcttcggataccgacaccggcaatgaggattccggtgacggcggatcgtatgacagcggcgacagcggcgattccggtgatgacagcggagacggcggtgacagcggagacgattcgggcgacagcggcgattccggtgacgacagcggagacagcggcgacagctcggaggatccggaagcataaagccgaattgttcggcacaaactgaaaactgaaaatcgttcagcgccgcacaaggccgcacaagtcggggcgttagcggtgccttgaacccgcaatccgcttcagcggggactatgcgggtaacaaggagcacacatgcggcgaggcagccactcacagggcgatgaggaaccggtactgcgcaacggaggactgtgaaccatgtcaggcggggaaccgagcagcattaagcagaaaccatcgtgtgccgcagatctgccgattctgagcccgaaatgcggaaaggcagccgggtgtgtgtattcgaattacctgtgtgcggtcttgtggggcgctgaacgattctcgatcgaaaccacgctttcgatcgaagggatatgccgagcctgcggctcggacaaatcccggcgggacaaaagttcctcccgatggtcgaaacttttgctccgtcttgtataaaaacccacgcacatgtcgcgggtttttatgaatcttacggcgtgaccgtaagattcgattgaatgccgccgtgaagcggcggagatcgatggctcggatttttgaaacaaaatcctgccatgcgggtacggtttgcaagcaaaccggtattgaatggcggacagagtccgcgagaggacgctttgaggcgggcttacgcccgcctctttattttattgaggggaggattttcgtttgtatcaggctttataccgcaaatggcggccgcagacgtttgcggatgtgattgggcagcagcatattacggacacgctgcgcgcgcagctgcagtccggacgtttgagccatgcatatctgtttacaggcacgcgcggcaccggcaagaccacctgtgcgaagatcctcgcgcgcgcggtcaactgtgagcatccggtgaacggcgatccgtgcaacgagtgtgcggcgtgccgcggcattctggacggctcggtgctggacgtgaccgagattgacgcggcgtccaacaacggtgtggacaacatccgcgacctgcgcgatgagacgcgctacacgcctgcacaggtccgcaagcgcgtgttcatcatcgacgaggtacacatgctgtccatcggtgcattcaatgcgctgctcaaaacactcgaggagccgccggagcacgttctgttcatcctcgctaccaccgagctgcacaaggtacctgcgaccattctgtcgcgctgtcagcggtttgatttccgccgcattggcgcggaggacatttcccgccggctgctggatgttgcggcaggtgagggcattgcgctgaccgaaggtgcggcacgcctgatcgcccggctggcggacggcgccatgcgagacgcgctttccatgctcgaccgtgcggcggcagccggtgcggtggacgagaaaacggtcacggcggcgctcggcgtcatgggtcaggacgatggcattcgcctggccgagcacctgaaaacgggtgatctcgcggcggcagtcggcctgctggacgaatattacaacgcaggccgcgatctggcctcggtgtacgaccagatgctcggcctgatacgcgatgcactgctggtcaagaccagcaagaccgacgtttccgcgcttatttctccggcgtacagcgtaaagacgctgcaggcgctgtgtgacggtctggcgtcgtccacgctcatcgcgtggagccgcattatcagcgattcgctcgaccatatgcgcacggcagccaaccgccgcgtggaggcggagctgtgcgcggtgcggctgtgcagcctgggcgctgacaattacgacacgctcggcgggcgtgtagaagcgctcgaggaaaagctgaagaacggcattccggtgcagatggtgcccgcagcagccgcgcagcaggtaggcgatgtgccgcctccgccgagtgacgatgatgcaccaccgcttccgggcgacgaggatgcgcctgactgggcgcgagaggaagacgggaccgcagacacgcctaagcaggaagtgacgctgtggagccagtggcagccgctgctcgaagcgctgaccggcaagatcaacatcggcgcacacaccaatattaagctgagcgcgaaaggcatgctcgaggacaacgcgctcgtcattctctgcgaggataaaatgacggccattctcgcggcaaaggagccgaccatttcggtcatccgggagcaggcggccaagctgaacggtgcacccatcaaggtcaaggtgcgcgaagcgggcgaggagcttgttgtgaaaaaaaatatcgcagtcgatgaactgatcgaccgcgctaaatcaatggatattcaagtgaaacagctttaaggaggacatttattatggcaaagggtaagggtttcggcggattcggcggcggcatgaacatgcaggcgatgatgaagcaggcacagaagatgcaggagagcatgctcaaggcgcaggaggagatcgcgcagatggaatccaccggcacggcaggcggcggcatggttaccgcgactgtaaccggcacttccacgctcaagagcattgcaatcaagccggacgttgttgatccggacgacatcgacatgctgcaggatctggtcgttgcagcggtcaatgaggcactcaaggcggcttccgataagtcgcagagccagatgtccgcgattacgggcggcatcggcggcggtctgggcggtctgctgtaatggagctttttgcaccgccggtcgaacggctgatcgaggagtttgcaaagctcccgggcatcggccagaagaccgcacagcggctggcgtttcatgtgctcgatctgccgaaagaggacgccgagcggtttgcggatgccatccgtgaagcaaaagccaagacgttcacctgcaggcgctgtcagaatctgacggacagcgagatctgtccgatctgttcggacaagacgcgcaaccagaaggtgatctgcgtggtggcagagccgcgcgacgtaatcgcgttcgagcgcacgaaggagtacaaggggttgtatcatgtgctgcacggcacgctgtctccgatgggacacgtcggaccggacgacatccgtatccgcgagctggtcaagcgcgtggcggaggaggagaccgaggaggttatcctcgccaccaatccggacaccgagggcgaagccacggcgatgtacatttcgcggctgctgcagccgttcggcatcaagattacgcggctggcgtatggtattccggttggcgggcatctggagtttgttgatgaggtgacgctgacccgtgcactggagggtcgaaaggagctgtaatggctcctttgcatccttgtaaggtttgcgtttgatggaaattggtgccgcagtatgcggcggttcttgcctacgcggcaggcgcacaagagggtagacaccaaggtttccaccctctgattttcacccctttcctgagggcacggcggcaatcagagaactgagactataagggaacggcagaggattttttctaccgtaggggcgcacagtgtgcgcccatgtctctgcctgtacgcagtgtcagattccttgctgctacacatacgggttcatctacgcaggcgcaacataacagtgttgcgcaacgattttactgggttgctgtgcatggcaccgttggagttaactggaagaagagcgtcagcgtgcagagcacgcccggtgacagcgtaccgctttgcggatcgagtgcaccggatagatggtgctgaatagaatttacaacgtaaactctcattttacctttaaaaaaggcaaaaaaacaggaacagccgaactttcgtccggctgctcccgcaataaaaggtaggatagagagtagaaagcaagaacatgtggggggatcttacgctttccacgtcatttataatactggtgaattgtgaacattctgtgtacattctacaacaatattagatttttgatagatcgggaggaaaaagtctgtggcagacctgaaaagagaaattgaaaatcggcgtacatttgcgatcatttcgcatcctgacgccggtaaaaccaccattacggagaagtttttgctctacggcggagccattcaggaggccggcatggttaagggcaagaaaaacagccgtcatgcggtttccgactggatggagatcgagaagcagcgcggtatttcggtaacgtcctcggtgctgcagttccgctatgagggcaagtgcatcaacattctggataccccggggcatcaggacttctcggaggatacctaccgcacgctgatggcggctgactcggcggtgatggtcattgacgcctccaagggcgtcgaggcacagacccgcaagctgttcaaggtctgcgcgatgcgcggcgtgccgatcttcacctttatcaacaagatggaccgtgaggcacgcgacccgtacgagctgctcgaggacatcgagaacgagctgggcattggcacctatgcggtaaactggccgatcggctcgggcaagcgcttcaagggcgtatacgaccgtatggacgatgaggttatcgcgtttgagggcgcggacttccgtcacgaggtcaaggcgcagcgcctgtcgatcgacgatccgattctcgagggactgctgcccgaggatcagtaccagacgctgatcgacgatgtggagctgctctccggtgcaggcgatgagtttgatctcaaggctgtccacgagggcaagctgtcgccggtgttcttcggttccgcgctgactaacttcggtgttgagccgttcctgaaaaagttcctgcagatgacgccgccgccgaccgcgcgtaccgctgacatcggtgtgatcgacccgttcgacccgcatttctccgcgtttgtgttcaagattcaggcgaacatgaacaaggcgcaccgcgaccgtgttgcgttcatgcgtatttgctccggcaagtttgagcgcggtcaggacgtgctgcacgttcagtccggcaagaagatggtgcttgccgcaccgcagcagctgatggcacaggaccgctccatcgtcgatgaggcgtatgcgggcgatattatcggtattttcgatccgggcgtgttctccatcggtgataccgtgtgcgatcccaagcataagtgcgtgttctccggcatcccgacgttcgcacccgagctgtttgccgttgtccgtcagaaggacacgctcaagcgcaagcagttcgtcaagggtgtcgagcagatcgcacaggagggcgctatccagatcttccgcgagccgaatgccggtatggaatcggttatcgtcggcgttgtcggcgtgctgcagtttgaggtgctcgagtaccgtttgaagaacgagtataacgttgagatcatccgcgaaaacctgccgtacgagcacgttcgctgggttgagaatgacgaggatgacttcgacatcaagaagctccagctcacgagtgataccaagatcgttgaggatctcaagggcaacagcctgctgctgttcacctcgccgtggaatatcacctacgcaaccgaccataacgagaacctgcgtctcgcggatttctcggaaaacgcgtaaaatgcctgtcgcgaaactacagtttcgccgacaagggggaacggaccgtgggccgttccaaagtcgtccgaaagttcctcctgatggtcgaaactttctccctccagaagtataaaaaccgagatacatgctcccggtttgctctcattaaatctttttaaggatagaggcctacgggctatgaatttgcatagcaaattctatttgaagcgcgctgacgcgcgaaatacgggacacaggcggctgtgccgccgggtcccgcacccgcgaacgcagttcgcggcataaaatacgcagtatgccccgcaaaccgcacccacaggacagccgcctgtcggcggtgagtccttcgcgggcgacagcgttcacgccaacccctaaaatccccgacggggatttcagcacccagataacctatcacgccgcggagcgcatcaaatggagcgctttcagcgcgacaaaaatggcccagctttgccgggtcatttttagcaaacaataaaagagcaccggaattcaattccggtgctcttttattgcggtagcccttacaggcagcgcctgtcaagggcgtccctcgattgaaaggactgcgccctttcaatcgaaaatcagcatacgccctgagccagcatagcgtcagcgatcttctcgaagccgccgatgttagcgcccataacaaggttgtccttgtggccgtacttctcagctgcagtgatgcaggtgtggaagatgttaaccatgatgtcgtgcagacgctggtcaacttcctcgaaggtccaggacagacgcagggagttctggctcatttccagaccggaggtagctacgccgcctgcgttagcagcctttgccgggccgaagaatacgccggctgcctggaatgctgcaacagcctccggggtggacggcatgttagcgccctcagctacaaacttgcagccgttggcgatcagagcctttgcgttctcctcgttcagctcgttctgagtagcgcacggcagagcgatgtcgcacttggtgccccacggacgctgaccctcggtgtaaacgctgcccggtacgcgctcagcgtactccttgatgcggccgcgcttaacttccttgatgtccttaacaacatccaggttgatgccgttcggatcgtagatgaagccgttggagtcggacatggtaacaaccttagcgcccagctgggtagccttctggcaagcgtagattgcaacgttgccggaaccggagattgcaacagtcttgccctcaaacgaagtacccttgtatgcgagcatttccttcatgtagtagcacagaccgtagccggtagcctcggtacgagccagagaaccgccgtaggacaggcccttgccggtcagaacgccggtgtactcgttgcgcagacgcttgtactgaccgaacaaaaagccgatctcacggccgccaacaccgatatcgccggccggtacgtcggtgaactgaccgatgtgcttgcacagctcggtcatgaaggactggcagaaacgcatgatttcagcatcggacttgcccttcgggtcgaagtcggagccgcccttgccgccgcccatcggcagagtggtcaggctgttcttgaagcactgctcaaagccgaggaacttgataacggatgcgttaacagaggggtgcagacgcagaccgcccttgtaggggccgattgcggagttgaactgtacacggaagccgcggttaacctgaaccttgccctgatcgtcaacccacggtacacggaacatgaacatgcgctccggctctacgatgcgctccatgatgccgttcttctcgagctccggacgagcttcaacaaccggctgaaggctctcgagaacctcgtaaactgcctgctggaactccggctcattcgggttgcgcttctgtacggtttcgtacacgccctgcagataagaattggtaagtgccatttttattgtcctccttacattctataccactcgcttaactttcgtaagtaatccgagtggaatgcttttatatttggtgacggttctattatatagcaatttttttgcatatgcaatactttagcacgataaaattatacagttttttaggccgaaaaacctatggatattggcaatctgacttgatataataaagccagtaccgcataattaaagcggcggtgctttgcgaaaatttactttcttgacttcggtgtgttttcttgcaatacgaaagtattgctgcaaaaccatgcctcgtcaaaaaagaaaatttgctcgcaaatcactcttgtttcattatgtggtattgactggtaaaagaaaggcggattagctatggcaaacagctttgagcgaatatatgcagtggtgaagaaaattccgcgcggaacggtggccagctacgggcaggtcgcgctgctcgcgggcaatccgagatgggcgcgcgttgttggctatgcactgcatgccaatcccgatccggaggggattccgtgctaccgcgtggtaacgaaagacggacgaacgtcaccggcgtttgcgttcggcggcgcggatatccagcgcgcactgctcgaagcggatggcatcgagttcaccgaggacggccgcgtggatatggcgaaatacggctggacaggattagggtaacaccgcacaattaaactgcggcgctttacggaaattttgtgctctgacgtcgttgtgctttcacggtaatacacaaagtattaccgcaaaatcacgcctagtcagaccgcaaaatttactcgtaaatcgctcttgttcaattatgtggtattaccctgacttgacaaatccggtcgtgcggtgctatgcttgcgccaaaggagtgacacgcatgatcgacatcgaaaagctgaccgcgctcgccatcgcgtatgacgcaggcgacgcaaaacggattcagcactttataaaggtatacgcgtacagccgcctgctcgggcgcagggaaggtctggatgagcagaagcagaatgtactcgaagctgcagccgttctgcacgatatcggcatccacgaagccgaacggaagcacggctcgagcagcggacactggcaggagatggaaggtccggcggtcgcggctcccatgctgcagcagtgcggcgcagatgagcgggagagcgagcgcgtgcagtggctcatcgcgcatcaccatacctataccgccggagaggaaaaagatttccgtattctgcttgaagcggacttccttgtcaacgcctacgaggacggtatgacggcagagcagtgtgaaaccgcgaaagaccgcgtgttccgaaccgaaaccggcaagcagtatcttgaagaaatgtttctcaaaccggcatatcaggcgaaataatggaaaattgaaaatggagacacccaccgcagtgggcgtccagcgagcaaccgcccatagggcggctcttagcgagtcggaatggagaatgaaccccgaggtagggcattctccattttttcatttttattgagtgccagccggatagcacggtgcgccgaggtcggcgcaccctacggtaaacattcattatcaaattaaactcgcaggtgccgtctgtagccaccagaccaacgaattgcgcgacacaggtatcccccaggggaccctctcttgccctttgggcaattcaccttgtgttgcacctgcggagagcaggccgcatgtgtagcagtacgttatctgtgaactgcgaatatgtggagaaatgggcgcacgctgtgcgcccctacggcagagtaacccgactgccgttctcatatttttcgcagcagtcgccggtctctggtatgcgtcaggttaagaaacaaaaggaagtgggagttaagagggtagaaaccattggtgtctaccctcttgcccctcgccgtgggtacggcgcgcccgccgggcaggcaagttccgttcgctttgcaagcgaccactccccgaaatgtgaacatttcgtgaaacccgttgacattgccgagtgacggtgtataatatgttagcaagctaacagtaaggaggctaacaatgaattgctgtgaccataatgaatgctgcggtcactcggacgaccgcatcggtgcagaaatcggcatgctgcataatctgcttcggcggcagatggcgtgtatgaccgaaaagactgcgaatgcagcgaatgtgaccggcatgcaggcgatgatcgtccatcacctgatcatacacgaaaagcagggcgatatattccagaaggatctggaaaacgcgttccagatgcgccgctcgaccgcaacgggcatactgcagctgatggagcagcacggcattatccgccgtgagccggtggagcatgacggccgcctgaaacgtctggtgctgaccgagcaggcgcgtgcaatggatgaatacattactgagcgcatgcagcagatggagcagcttctgcggcagggcatcacagaggacgagctgaagggctggtttgcggtctgtgaaaaaatccgctccaatctggagcagtaccaatgcaatatgtgcagggagggacagaaataatgataaaacgactgctgaaaagtgtgcgtgagttcaaaaaggacgcactgctcacgccgtttttcgttgtgctcgaggtcgtgatggaggtcatcattccgatggttatggcgctgctgatcgacaagggcattgacgggcaggatatggccgccatttggaaatacggcatcatccttgtgctgtgcgccatgctcgcgctggtgttcggcgcggcagccggcacctttgcggcgagagcctcaaccggctttgcccgcaatctgcgtcacgatatgtactacaatgtgcagaatttctcgttttccaacattgataagttctccaccggttcgatcgtcacccgtctgaccaccgatgttaccaacgtacagaacgcctttcagatgtgcacgcgcatcgcggtgcgctgcccggtcatgctggtctttgcgctgttcatggcgatgaagatcaacagcaggatggcgctcgtattcctcgcggtgctgccgattctggcaatcggcatgggcattctgatgaaggttgtcgatccggtctttgagcgcgcattcaagatctacgaccgcatgaacacggtcgtacaggaaaatgtgcgcggcatccgcgttgttaagacctatgtgcgtgaggaccacgagactgaaaagttcgagggcgtttctggcatgctgtaccgcacgttctccaaggcgcagaagaccatggcaggcgttatgccgctgatgcagttctgcatgtacgcgtgcatgctgctcatttcgtggttcggcgcgcgtctgatcgtcgtcggctcgatgaccaccggcgagctgaccagcatgttctcctacgcgatgcagatcctgatgagcctgatgatggtagcgatggttttcgttatgatcaccatggccaaggcgagcgcagagcgtgttgccgaaatcctcgatgagcagcccgacctgcacaaccccgcgaacccgattcacgaggtcaaggacggcgcgatcgagttcgatgacgtttccttcagctacaagggcgatgagcgcaagctggcgcttaaaaacgtcaacctgcatatcaaggccggtcagaccgtcggcattctcggcggcaccggttctgcgaagtctacgcttgtgcagctgattccgcgcctgtacgataccacgcacggcacggtcaaggtcggcggcgtggatgtccgcgattacgatatcgaggcgctgcgcgatcaggttgccatggtgctccagaagaacgtgctgttctccggcacgatcaaggaaaatcttcgctggggtgacgaaaacgcctcggacgaggagctcgagcgcgtatgccgtttggcacaggcggatgaattcatccagcagatgccggataagtacgacacccacattgagcagggcggctcgaatgtctccggcggtcagaagcagcgcctgtgcattgcgcgtgcgctgctgaaaaagccgaagatcctcattcttgatgactcgaccagcgcggtcgataccaagacggatgcgctcatccgcaaggcattcgcggaggaaatcccggacacgaccaagattatcattgcacagcgtgtttcctctgtgcaggatgcggatcagatcgtcattctcgacggcggcaccgtgcaggctgtcggcacgcacgatgagctgctcgccgccaacacgatctatcaggaaatctacaaccagcagaacagaaagggcggtgaggaataatggcaagacctcagatgcgcggacccggcggccgcagaggcatgatgggcggcaagcgcagcaaaaatccgaaaaagacgctcggacgtcttatgaaatatattcagaagggctacggcgtacagtttgtggtcgtactgatctgcattcttctgtcggctgtggcaaacgtggcaggctccatgttcctcaaaagcctgatcgacgactatatttctccgctgctgctgcaggcatctccggtgtttaccggtctgctgcatgcactgatgagtatggcggtgatctatctcatcggcattgcgactacgttcatctacaactggctgatggtcggcatttcgcagggcgtgctcaaaaaggtgcgtgacgagatgttcgcgcacatgcagaagctgccgattcgctacttcgatacgcatacccacggcgatctgatgagccatttcaccaacgataccgatacgctgcagcagatgctcagccagtccgtgccgcagatgttttcctcggcgatgaccattatctcggtgttcatcggcatgctggtgacgaatgtatggctgacgctgttcgtactgctcggcgtgtgcgtcatgctcaaggtggtaaagaagctgggcggtcagtccgcgaagtacttcctcgagcagcagaagtcgctcggcagggtcaacggctatatcgaggagatgatcaacggtcagaaggtcatcaaggtgttctgccacgaggaaaagtgcaaggagcagttcgatgagctcaacgatgagctgcgtgagaatgctgcgagtgcgaataccttcgcaaacatcctcatgccgatcatgatgaacatcggcaacctgctgtacgttctggtggcggttgtcggcggtgcgctggcgctgtccggcgtggtcggaaacagcatcaccatcggcgttatcgcgtccttcctgcagctgaccaagtcgttcacccagccggtaacgcagatttcgcagcagttcaactccatcgttatggcgcttgccggtgccgagcgtatctttgagctgatggacgaggagcctgaggtagacaacggctacgttactctcgttaacgccaagtacgacaagaacggcgaactcattgaaaccccggaaaagaccaacatctgggcgtggaagcacccgcacgaggacggcaccaccacctacacgcaggtccgcggcgatgtccgcttcttcgatgtggatttcggttataacccggataagattgttttgcacgacatcacgctgtacgctgagcccggtcagaaggtcgcgttcgtcggtgcaaccggcgcgggcaaaacgaccatcaccaacctgatcaaccgtttctacgacctcgcggacggcaagatccgctacgacggcatcaatatcaataagatcaaaaaagccgatcttcgccgctcgctcggcatcgttctgcaggataccaacctgtttaccggcactatccgcgataatatccgctacggtcgtctggatgcgaccgacgaggaagtcgtggctgccgctcagcttgccaatgcggacgacttcatccgccgactgccggacggctacgataccgtcatcgacggcgacggcggcagtctgtcgcagggtcagtgccagctgctttccatcgcgcgtgcggctgttgccgatccgccggttatgatcctcgatgaggcgaccagctcgattgatacccgcacggagtccatcgtgcaggccggcatggacggcctcatgtacggacgtacggtgttcgttatcgcgcaccgcctgtccacgattcaaaacgcagacgttattatggtgctgcagctcggtcatatcatcgagcgcggcaaccatgagcagctgattgcggaacacggcaaatattatcagctctataccggagcgtttgagctggagtaagataaaagaacccgaaacgagagtttcgggttcttttttgtgcaaaattgagaattgaaaatggagaatagagaattgacatggtggttttccgttgtgtgggcggtcaatgaccgcccctacgggtatgcaaggtgcggatgggtgacaagcggtgcgccgaggtcgtcgcaccctacggtataacatttatcatcagataaagcccggaggtgccgtccgtaataacgagcaaacgagttgcgcgacacgggtatgtcgcgcctgcggagagtaaaccgcatgtgtagcagtacggtatctgtgaactgcgaatatttcacgaaagacacggtagagtaacccgactgccgtaccccattttcggagcggtcgccggtctctggtctgcgccgagttatgccaagggtggaaacgggagtcccaagagggtagaaaccaccgcaggtggtgtctatccttttggcccgccgcgctaacgacagcgcatatccgcacattccaacactttataagcgccgctgtctatccttttgtttctgtggcgaaaccgccacttttacgcgctcgaaagttggaatatgcgcttaacttttttcaaaacgcaattcccgctgttatttcccgccaagcggcacgtctgcattgggatatactgggaaaacagcaagggaggcgtaacgaaatggataaacaaagggcaagacggtccgcgtcgataccggtgcggatcgggcatgcagcagcatgggctgccggattatggaaacaggaacatttgcggacgctcatcacaggcgcacagcgattcgtgctgtgtgcggtgctggcacagggaaccatccttggtgggtacatgccgttcgggctggcgatgacggcggccttgatggctcgaggagcaggtctgtccgcgctcggcggtctggtgtgcggcgtcatgctgcgcggcgacggattccacggcggcatttacgccgcggcagcgctgctggtgctgtgcgtgatgagcgtgtgtgccggtctgcgcgtgatgtctgagcggtggtttgcgcccggtgtggcaacgtttgcaagcgcggcgtgtacattcgtgtttctgccgctcggcgcagagctgaccgcaccggcggtgctgacattcctgctcgtgcagggcatcacgtttggcgtgtgctggatgtacggcgcggcctttgcaccgccgcgcgacgaaaacgactggcgcagaccggtaacgcttttggtgctgaccgcaaccgtgcttttatcgctttcgggtatcaatctattcggcgtgttcgctcccgcgagagcgggcgcgctgctgctcgtgctggcggcggcgtatctcggcggaccggcggcgggcgcggcagccggtgtcgcgttcggcgcggcaatggatctcaacatcggctacggagccttgttcacctgctgctatggcctgtgtgcgctcgttgccggactgtttcatgacagcggccgcggctggttttcggtctgtgcgctcggcggcggactgtgcgcggctatgctcggcgtggagcatccgctgtttattccgctgatcgcagagctgttctgcgcggtcctcatgttcgcggcgctgccgcccttcgtgtgggaggccatccggcgcagcctgctgccggatacactgatgggcgaagccgccagtcagcgtgtgcgcagactcgcgggcacctgtgcgaccgaggcggcgcaggcgttctacgagctgtaccttgctatgctgcacggcgtcagcgagggcaaagccgccggagaccggaatattcgggcggtattcgactacgcgagcgatcatgtctgcaaaaactgcatgctgtgtacgcagtgctggcagcgggactatgtgagcacgctggcggcgctcaatgatgtgacccagccgatgctgcagcgcgggcgagcggaaatgagcgattttccctatcattttgcggcacggtgtgcgcgtctgcccgagctgatgcgtgccatcaacagtgcgttgtttgcgctgcgcgagcgcgaaagccttcggcggcagcaggaggaaaaccagagcctgcttgccaggcaatacgcaggcattacggatattcttcggcagcttggcgcggaggtcacgcaggatgaaacggcgcagccgctgatggaacggcaggtgcgccggtacgcagcagcgttcggatggatcgaccgcgtgtgcgcggtgcgggattcgcagggcaggctgaccgttgaactgtacggcgagggcattgacgacatcatgaagcagggggacggcttttcggccggcctgtcggcgctgctgggtgtgacgctgaccgcaccggagaagaaaaagggcagccagggtatccacgttgagatgcatgaacgggcgccgtaccgtgcggtggtaggcattggtcgtcagcagaaggagggcgcgtcggtctcgggcgacaacgcgtgctactttctcaccgacaccggaacggcgtgcctgctcctgtcggacggcatgggctcgggtgccgccgcgtcgcgggacagccgcatgctcatcacctcgctcgagcggttcctgcgtgcaggcatttcggtcggagacgcgctgcacgcggtctctccggcgctgcgcctgcggtcagacggcatgcgcttcaccacactggacgcattcacgctcgacctgttcagcggacgcgcggaaaacctcaagtgcggcgccgcaccgacctacatgcggctgaacggtcgatggaccattctgccgggcacggcgctgcccatcggtctggcggaggaggacgagttgggcgatgccgtgccgctgcaaatgaacgacggcgatatcgtggttctgctctcggacggcgtgaccgacggcacggacgataaatgggtgcggcagctgctcatcgcgcatgcaggcgacagcccgaaggagatcgcggcacagcttgtgaacgaggcgaaaggccgcggacacgatgacgatcggactgtaatggtcatgaaaattgaaaagctggaatgagactggtataaaatcacgaaagaggggaatgatggaacaaagggaaaaggaggaatctatatggtacgaggtgtcagccgccgcgtcattgtcgtcaagccggagcagccggcgctgttcgagcaggctattttccttgtgcgggactacaatgcgccgcgcggcgacatggtgcgggaggcctgccgcatcgcaaacagctatctgccgcgcagacggcggtcgagaagaaaggcggacggtctttctttgcttgccggattttgggctggcgcactgctcatcggcaccatttgggcgctgacggcgctcgttttgtaaacagattataaaatgagcggccgttcccttgtacccttcggttttggttggtatactatagtacacagacgaaaatttcggttttcgcttactatagatcaaacggaggcggctattatgacggccgaaaccttttttcagctgttcaaccagtacggactgatcctggtctgtgccgtggttttctgcgaatatatgaacctgcccggatttccggcaggcgttatcatgccgtgcgtcggtgtgctgattgcccggagcgagctgtcgttgccgctgacggtttttctgagcgtggtcgccggtgtgctcggcagtctggtcatctacgccgtgtgctactggggcggcgaaccggtgatggagaagctgttcggcaggagcaagaaattcaagtctctcgtgcgtaaatgccatgaatttatcgacgcacagcatgggcgcggactggcgatcatccgcgtgattccgtgtatccgcaccattgtttccatcccggccggactgctccggatgccggtcaagtggttcgtcggctggtctgcggcgggcatcacggtgtggaataccgcgctcatttcattcgggtatttcttcagcgagaagattctcagcatggtaatgtaaccaaatatatcgacagggtaaatcctcggatttgccctgtttttgcgtttttcggtcgaaaaatgggtgcatccattctgtaagttgcatttgcagtcgcgttatggtaaaatatacaccgttatataatatgtataagacggaggaacgatatgcagatcggcaacgtaacaatcaacggaaaactggcgcttgcaccgatggcaggcgtgaccgatcttgcattccgccatatctgccgggagcacggcgcggcgctgaccgtgaccgaaatggtctccgcaaaggcgctgtgctataaggataagaaaacgccgcgtttgctcgaactgggggcgaacgagcatccggcggctgtccagatcttcgggcacgagccggacacgatggccgaaggcgcgaaactggcgctggagaaatccggctgtgatatcatcgacatcaacatgggctgtccggcgccgaagatcgtgaacaacggtgacggctccgcgctgatgaaggacccggagcttgcgtccaaggtgattgcagcggtcgtaaacgcggtcgatgtgccggtaacggtcaagtttcgcaagggctgggatgaaaaaagcgtcaactgcgtggaatttgcaaaaatggctgagcagtccggcgcggcagcgatcacgctgcacggacgcacgcgctcgcagcagtacagcggcaccgccgactgggatgtgattcgtgaagtcaagcaggcggtttgcattccggtgttcgccaacggagatgtggccgaacccgaggacgcggtccgcattctcgcgcacaccggcgcggacggcgtgatgatcgggcgaggttcgctcggtgatccgtggctgttcgagcgggcgaatgcactgctcgagaccggcatctgtccggcgctgccgtcgttcacagagcgtattgacacggccgtgcggcagatcgagcttgccgccgagcagaagggcgagcatatcgccatgctcgaggcacgccgacacgttaactgctatctcaagtgggaaagcggtgtcaagacgttcaagaaccgcatttgcgcactcaccaagctgagtgatctgtatgaaattgcagacgaactgaaagccttcgtttcggcgaaggagaacatataataaggtaagagaaagagaggggagacgcagtggacgacaagcatattgtggcgcaggcgcggcgcggcgagctttccgcctttgaggagctggtaacgcgctacgaaaagcgcgtgtatgcgatcgcgctgcgctcgtccggctcgccggaggatgccgcagatatcacgcaggaggttttccttcgggcatggcgctcgatgaaggacttccgcggggacagcggctttgcgacctggctgttccgcatcacgatgaaccagtgcgtcgattacgcgcggcataagcagagccagccgccgacgcagccgctcgtgcagggcgaggatgacgaggaacgcgaactgccgcttccggatacggctccatctcccgaggagcacctggagaacagcgagctgggacgcgagcttgccgccgcgctcgatgaggtgagcgacgagcaccgcagaatcgtcctgctgcgggacgtttccggcatgagctacaccgagatcgctgagatactcgaggtcagcgaaggtacggtaaagtcgcggctgtcacgcgcacgcattgctttacgcaaaattttactcaaacgagggaacctttttcatttgccttcgtctaaagatatggaaggaggcgaggagcatgaatgaggaggaatattttgaacagctttgctcgaacagtgtggacggaaccctgaccgattccgaaaagcaaaagctggaggagcatctggcagagtgcccatcgtgcgccgcgctgaaagaggatctggagcagatgcacagtatgctggcggtggacgaaaccgagccgccggccggactgcatgacagcataatggaacgtctgcggcaggaggaaaccgttcgggtgatcgcgccgcaaaagccgatgcgccgtctgccggtgtttacgatggtagccgctgcggcggttgtcgtgctggtcgtgctcggcggcggactgatgcccgcgttcagtacggtgggcagcggcagcacggcggcagcggattccgcttcggcggacgcaggagacggcacggcggacggcagtatgcaggatgagatcgagcagtccgtgcgggagaacgccgatgcatcgagcggcggagcatcgaattcgagcgtgcagcagagcggcacggcttcgcagagcacgaacggcagcgcatacagcggacagagtgacaccggcgaggactctgcggcgaatacgcagagcgatgcgggcatcgatgccgagcagtatgcagacagcgagcggtcgatcgcagctcctgagccaattgctgatgagtcggtacagacacaggtgcagacccgtccggtgctcacgctaccgcaaagcctgcacggcgcacacaccgcgtactgctatgtggccatcggcggcagcagcctgccggatattgatggtgaactgctcgcgcaggagaacggcgtttcgtggttccggctggacaacagtatggaaacgctcgaaaagactctgcagacagtagaacaggctggctgcacggtgactgcctatgataaggtcgatctgatgatcgacagccatgcagattcgtggatcttagcggttgttaccggttgagattgggcaaaacagacctgaaacgatggttttcgggtctgtttttgtgcataacgcgaaaaattccgatttacacaaaaaatcgctgaaaattttgtgcaaacacttgactttcccatgaaagtattgtattatgtataagcacttgcgagagcaagttaaaacgcgatgataccggagattgctgctgtgagcaggtaacttcggtggagtaggtccgacaatcgggcggttgagataactgctatcagctgaattcagatattcagcaaaaacgcaatgttcatgcgtaaattcgggactcgcggcgcgtgcgccgtcaagccgatggtttgaaccacttgcgtttcttatcgtgaccggattgttgcgctgcggagtcagtgcgcccggttattttcatgcccgttgcgtgatacgcacggcggagttgcagtttctctccgtagcgagtcaaaacattatttaatgtatggcacacatacgaggaggaaattccacaatggcaaacgcacagaagattcgcattcgcctgaaggcgtatgatcacgagctgatcgaccagtccgcagagaagatcatcgagaccgctaagcgcaacggcgctaaggtttccggcccgatcccgctgccgaccgagaagcagatcgttaccatcctgcgtgctgttcacaagtacaaggattctcgtgagcagttcgagcgccgcacccacaagcgcctgatcgacatcatcaacccgaatcaggctaccatcgaggctctgaccactctcgacctgccggctggcgtcgagttcgaggttaagctctaatttaagttaacaagctgaccggattaacccaccggcggtttgaagccctgccgcgacacgcgcggcgaggtcatgttggcggtcaaatgccgtcaaccaataacctttaaggaggaaaaacaaatgctgaacaaagcaatcatcggcaagaaggtcggtatgacccagatcttcaatgctgacggcaaggttattccctgcaccgtaatcgaagcaggtccttgcgttgtaactcagctcaagaccgaagagaaggacggctacaatgctgtacagttcggttttgaggatgttaaggaagctcgcctgaacaagccccagaagggtcacctgaagaaggctggcgactccctgaagaagtacctgaaggagttccgttttgaggactgcactccgttccagctcggcgatgttgttaaggctgacatgttcgttaccggcgattatgttgacgttaccggcacttccaagggcaagggctacgctggcgtaatcaagcgcttcaacgcatcccgcctgaaggaaagccacggtaccggccctgtacaccgccatgcgggttctatgggcgcttgctctgatccgtccaagatcatgaagggcaagatgatgccgggtcacatgggcgctgagcaggttactgttcagaacctggacgttgtaaaggttgacgctgagcttaacctgatcgccgtttgcggcgcagttccgggcccgaagggcggcatcgtagtgctgaagaacaccgttaagaacaacaaggttgccaagggcgaggctggcatcagcaagaacccgcagaaggcttccgcaagaaagtaagggaaggaggagcaaatcatgcctacagtagcagtttttgatatgaccggtaagaagaccggcgagatggagctgaacgcggctgttttcggtatcgagccgaacatgaccgttgtacacgctgcagtaaagaattatctggctaaccagcgtcagggcactcagtccacgctgacccgcgccgaggttcgtggcggcggcatcaagccgtggcgtcagaagggcaccggccgtgctcgtcagggttctatccgctctccgcagtggacccatggtggtattgccctcggcccgaagccccgttcctacaactacagcctgaccaagaagaccaagcgtctggctatgctgtccgctctgtctgcaaaggcagcagcaggcgagatcatcgtaatcgatggcctggatatgggcgagatcaagaccaagtccttcgttggtttcctgaacgcagttgaggcaaccggcaagagcctggtagttactccggaagttcgcaccaacgtagttaagtctgcggcaaacatcccgggcgtacgcaccacgatcgcgtctaccctcaatgtatacgatatcctcaatgctgacaagttcatcatcgacaaggcagcagttgagaagctgcaggaggtatacgcataatgaagtacgcatacgacattatcaagaagccgatcatcaccgagcgttccatgatgggcgcacaggacaacaagtacaccttcgaagtagcgatcgatgccggcaaggtagagatcaagaaggctgtagaggagatcttcggcgttaaggttgccaaggttaacaccatcaagctgccgggcaagtggaagcgcatgggcgttcacgttggcaagcgttccgacatcaagaaggcgatcgtaaccctgaccgctgactccaagaagatcgagatcttcgagaacatgatgtaaaaaccacttcggctgctaaggcgagcctgagtgttcccgcgaagcgggttttcaatagaatctgcttgcagattcataaaaaccgggagcatgtatcacggtttttatacaagagcgaagaaaagtttcgctggtcggaacttttcgcagccttggtttcatccgcgctgtgcgcggtggaacctctctcgtttgaaaacgtgttttcaaacgaagtaattgtatggggaagccaccccgataataacgtatcaaggagttgaaattccaaatggctatcaagactttcaacccgacgacgccctcgcgcagaaatatgactgtgctttcctacaagggtctgtctaaggtgaagcccgagaagagccttctcgaaaaggtcaagaagaccgctggccgcaacagctacggccgcatcaccgttcgccacatcggcggcggcaacaagaagaagtaccgtatcattgacttcaagcgtcagaagctcgacgtttacgccgaggttaagaccatggagtatgatccgaaccgttccgctaacatcgctctcgttcagtacgaggacggcgagaaggcatatatcctcgctcccgagggcctgaagattggcgacaaggtcgtttcttccaaggatgccgacatcaagcccggcaactgcctgccggttgagaacattccggttggtaccatgatccacaacatcgagctgtacccgggcaagggcgcacagctggttcgttccgcaggcgtcggcgctcagctgatggctaaggaaggcggcaaggcaatggttcgtctgccctccggtgagctgcgttacgtccgtctggactgcaaggctaccatcggcgttgttggtaactctgatcattctaacgtacagctgggtaaggctggccgtacccgtcatctgggtatccgtccgaccgttcgtggttctgtaatgaacccgtgcgatcacccgcacggcggcggcgaaggcaagagcccgatcggtcgtccgtctccggttaccccgtggggcaagccggctatgggttacaagacccgcaagaagaaccaccgcaccgacaagcagatcgctcgtcgtcgcaacggcaagtaagaaaggagttatcttaatatgggcagaagtgttaagaaaggcccttttgtggctcctgagcttatcaaaagagtcgttgaaatgaacgaaaagggcgagaagaaggtcctcaagacctggtcccgcgcttccacgatcttccctgagttcgtcggtcatactatcgcagtacacgacggccgcaagcacgttccggtatacgttaccgaggacatggttggtcacaagctgggcgagtttgctcccacccgtacctacaagggtcacgcgggcagcaagacctccaataacggcaagtaaggaggagttaaagtaacatggaagcaagagctattgtacgcaacgtacgcatgaccccgcgaaagatcaagctgatctgcgatctgatccgcggcaaggatgcgggcgaagctatggccatcatcatgaatacccccaaggcagcatgcgagccgatggagaagctcctcaagagcgcagttgccaatgccgagaacaatcacggcatgaacaccgacaagctttacgttaaggaagttcacgtcggtcccggtccgatcatgaagcgcgttatgccgcgtgcacagggccgtgcattcagaatcctcaagagaacctcgcacgtaacgctggttcttggcgagaaagaataagggagggtaatcaatgggccagaaagtaaatccgaacggtctccgtgtcggcgttatcaagaattgggattcccgttggttcgctaaggacaatgtgttcggcgacctcctcgtggaagactacgagatccgtaaggatctgaagaagcgtctgtacgacgcaggcgttccggcgatcgagatcgagcgcaagaacgacgaaatcaagatcatgatccagtgcgcacgtcccggcatggttgtcggccgcggcggcgaggacatcaagaagctcgaagaagagctgaccaagaagtacggcaagaaggttcgctgctccatcatcgagatcaagaacccggacaccaacgctaccctggttgctgagaacattgcagctcagctcgagaagcgcatcggtttccgccgtgcaatgaagcagtccatgggccgtgcaatgcgcatgggcgccaagggcatcaaggtttcctgcggcggccgtctgggcggcgcggaaatcgcacgcaccgagcattaccacgagggcaccattccgctgcagaccctgcgtgcggacatcgactatggttttgctgaagctgcgaccacctacggccgcatcggtgttaaggtatggatctacaagggtgaggttctccacggcggtccgcgtctgggtcgctccattgaagctccgaagccggcattcgagcgccgcgatcgtcgcggtgaccgtcgcggccgtcgtgacttcaaccgtggcgagcgtcgtgctccccgtcaggaaggaggcaaccgttaatgctgctccctaagagagttaagtatcgtcgcgttcatcgcggccgtatgaccggcaaggctacccgcggtaacttcgtatcgaacggtgagttcggtatccaggctaccgagccgtgctggatcacctcgaatcagatcgaggcagcccgtatcgctatgacccgttacaccaagcgtggcggtcaggtatggatcaagattttccccgacaagccggttaccaagcatccggctggtgctcgaatgggttccggtaagggcgcacccgagtactgggttgcagtagttaagccgggccgtgtactgtttgagatcgcaggcgtttccgaggaagttgctcgtgaggcactgcgtctggcaagccacaagctgccctgcaagaccaagttcgttgcccgtgagaagaatggcggtgaagcatgatgaaggcatctgagatcagagaactgacggctgaggagctgtctgcaaagctcggtgagctgaagaaggacctcttcaacctccgtctgcagctcgctaccaatcagctcgacaacaccaacaagatcaatgaagtcaagcacgacattgctcgtatcaataccgttatccgcgagaagcagatcgcggagaaggcataagggagggaaacgaatattatgagcgaaagagcattacgcaaaacgcgagtaggcaaggtcgtttccgataagatggataagaccattgtcgtagcaattgaggatcgtgtagcacatcctctgtacaagaaggttattccgcacacctataagctgaaggcacacgacgagaacaacgagtgtggcatcggtgataaggttaaggtgatggagacccgtccgctgtccaaggacaagcgctggcgcctggtcgagatcatcgagaaggcaaagtaaggaggagagcacatggttcagcaggaaagctttctgcgtgcagctgacaacagcggcgcaaaggaactgaaggtaatccgtgttctcggcggctccgcacgcaagtacggcaacatcggtgacgtagttgtttgctcggtgcgcaagtgcaccccgggcggcggcgtaaagaagggcgatgtcgttaaggcagttatcgtccgcaccgttaagggcctgcgccgcgctgacggcagctatatccgctttgacgagaacgctggcgttatcattcgtgatgacaaaaacccccgcggcacccgtatctttgggcctgtcgctcgtgagctgcgtgacaaggattacatgaagatcctgtcgcttgctccggaagtactgtaaggaggtcgccaacaaatgaacaatttgcacgttaagacgggcgacaccgcagtcgttctttccggcaaggaaaagggcaagcgcggcaagatcctgtccgtaaacccgaagaagggtatggtagtaatcgaaggtgtgaacatgatcaagtgccacaccaagccccgccgtcagggtgaaaccggcggcatcatcgagcgcgagggtgcgctgcgtgcctgcaaggtaatgcgcgtatgcccgaagtgcgacaagccgactcgtgttgctcacaagatcaccgagaacggcactaaactgacggtgtgcaagcactgcggcgaaacgctttaagaagaggaggttgcaataaatggttccgaatatgaaagcaaagtatactgcggaagttgcgcctgctctgatgaagaagtttcagtacgagagcgcaatgcagattccgaagctcgacaagatcgtaatcaatgtcggctgcggtaaggaagcaaacggtaactccaaggttatcgaggctattgtccgtgatatcaccctgatctccggccagaagccgatcatcacccacgctaagaagtccatcgcaaacttcaagctgcgtgacggcatgccggtaggcgttaaggtaaccctgcgccgtgaccgcatgtgggagttcctggatcgtctgttcaacgtagctctgccgcgtgtacgcgacttccgcggcatcaacggcaacgcatttgacggccgtggcaactacgctctgggtctgagcgagcagctgatcttcccggaaatttcctacgatcagattgacaagatccgcggcatgaacatcgttatctgcaccactgcaaataccgatgaagaagcaaaggagctgcttactctgatgggcgctccgtttgagaagtaaggaggagaagttaaatggctaagaagtcgatggttctcaagcagcaggctaagccgaagttctccagccgagcttacaaccgctgcaagatctgcggccgtccgcacgcttacctgcgtgatttcggtatctgccgtatctgcttccgcgagctggcttacaagggtcagatcccgggtgtccgcaaggcatcctggtaaggaagaacgatttcaaaaaggaacccgtaagggttcctttttttatgctctaacggtgggcagagaccatttctgcaccgacttatcggggtacacgaaccgcgcaggcggttcgccctaacgggcggcagtctttttcagcaccggctgagcggggtacgcgaactgccgcaggcgtgttcgccctttccgggcggagagtttttcgctgcacctcagcgggggattcgccgtctgcggacggcgggaacgtgccgcgccccgcggcaggggcaaaaaggaagggacacctgcggtttcccttcctctttgaactcctacctttcccttatttgttagcctgacgcaaatcagagaccggcgaccgcttcgaaacaggggaacggcagaggatttttcctaccgtaggggagcacagtgtgctcccatttctctacctattcgcagtgccagacagtttactgctacacaggcggtttactctacgcaggcgcgacacaaggtgaattgcccggagggcaagagagggtcccctgggggatgcccgtgtcgcgcaattcgtttgtgcgttattacggatagttcctgcgggtaatacatgagggtaaatgttatcgtagggcggggtgccctcaccccgccgtataacaacggaaaacatcacgttaaatcttcattttaacgaaaaaatccggttttcctcttgcattttcccgcaaaatgtgttttaattattctgttataaatatttcaatgcgatgagcaggaaaagtaacgctgtgttcctctttctcagagagaacggtcccatggctgtaagccgtttatcgaggtatggcgcgaagttcccctgtgagcaccggtgctgaatagatgcagtaggcgccggcgaagtaacgctccgttaccggcgttcaatgagtgcccgattttttcgggaatcagggtggtaccacggaagttttacgcctttcgtccctattttacggggacggaaggcgttttttattaccactgtaatggatgatacccgtagggcgcgacgactcggcgcgccgcatcgaacggcagctgatgatttcagacggcgtgccgaggtcgtcacgccctacgaactatccgccctcactctatcacaaaatcacattccaaaggagaattggtatgaaagaaaagctgcaaggcattttgcagaccgcgaaggagcagctcgctgccgcgaaggattcgcgcgcgctggacgaggcccgcgtcaagttcctcggcaaaaagggtgagctgaccgcgctgctcaagggcatgaaggacgttgccgcagaggagcgtccggttgttggtcagctgatcaacgacgttcgtgcggagatcgaaaccatcattgacaagcagaagaagctgatcgagcaggctgcgctcgagaagaagctggaggcggagaccatcgacgttaccctgccgggtgaggacgttgtcatcggcaagaagcatccgctgaacatcgtgctcgacgagttcaaggagattttccttggtatgggcttctcgatcgctgagggtccggaggttgagctggatcactacaactttgaggcgctgaacattccgaaggaccatccggcacgcgacacgcaggataccttctatatttcggataatgttgtgctccgcacgcagacctctccgatgcaggtccgcacgatggaaaagcgtaagccgccgatccgcattatcgcgccgggccgtgtttaccgttcggacgccgttgacgcaacccactctccgctgttccatcagatcgagggtctggttgtcgataagggcatccgcatgagcgacctgaagggcattctcgagctgttcgcaaagaagctgtacggcgaggacacggttgttcgtttccgtccgcatcacttcccgttcaccgagccgtctgcggagatggatatccagtgctaccgctgccacggtgaaggctgcccgctctgcaagggtgagggctggatcgagatcctcggctgcggcatggttcaccccaaggtgcttgagatgagcggcatcgacccgaatgaatactccggctacgccttcggcatcggtctggagcgtatggttatgggccgcttcaagatcgacgatatccgtctgttctatgagaacgacgttcgattcctgcaccagttctaagcgctgacgcgcttataggggacttcaaaagtcccctatatacgaaaaacggttcctgacgaaaccgcttttcgatacccgaacgacgccgcccacggcggctgggtcggggtgtaaaaacgcaggtacacgccccgcgtttttacgaaacagcaaggctgtttctatttcatgcgcgcctgatggcgcgataccatcaaggaggaaatatcctatgaagttgccattatcttggctttcggattataccgatatgaacggcatcaccccgaaggagtatgatgccaagctgactatgtccggctccaaggtcgaggaggtttactacctcggcgcggagatcgacaacgttgtgaccggcaagatcctcgaggttgtcgatcacccggattccgaccatctgaagatctgccagctcgatgtcggcaaggaggagccggtgcagatcgtcaccggcgcacccaatgtaacgcctgcgtccgttggcgagatctgcccggtctgcctgcacaagtccaccctgccgggcggcgtgaagatcaccaagggcaagctgcgcggcgtgccgtccaacggcatgatgtgctcgttccaggagctgggtctgtcccacggctgcgtaccgtatgcgtgcgagaacggcatcctgttcctgccggccggcaccccggttggcgaggacatcaagaaggtgctcggtctggacgactgggtttccgattttgagattacgtccaaccgcccggactgcctgagcgtgatcggtctggcccgcgagactgcggctaccttcgaccgtccgttcagcgtcaagaccccggaggtcaagggcgtgggcgacgacatcaacaagtatatgtcggttgaggtcaaggacaccgacctgtgcccgcgctacaccgcccgcattgtcaagaatatcaagatcgagccgtctccggcgtggatgcgcgagcgtctgcacgcctgcggcgttcgtccgatcaacaacatcgttgatatcaccaactatgttatgctcgagtacggccagccgatgcatgcgttcgactacaagtgcctgtccgatggccgcattgttgtccgccgtgcccgcaacggtgagtccatccagactctggacggcgtggatcacgatctgagtgataaaatgctcgccatctgcgacaacgacaagccggttgctgttgcgggtgttatgggcggcgcaaactccgagattatggacgacaccaagaccgtcgttttcgagtccgcaaacttccacggcgctaccgttcgtatcaccgcaaaggcgctcggcatgcgtaccgaggcctccggccgctttgagaagggccttgacccgcgcatgaccctcgatgcggtcaaccgtgcgtgcgagctggtggagcagctgggcgcaggcgaggtcatcgacggcattatcgacgttgacaactccgacccgaaccataagcgtctgccgttcgagccggacaagatgaatgccctgctcggtctggagctgtccgctgaggagcaggtaaagctgctcgagaagctggacttcaagatcgagaataacgaggttgttgtgccgttcttccgcaccgacatcaaccgcatgtgcgacgtggctgaggaggttgcccgcatgtacggctacgacaagatcccgaccacgctgtacgcaggcgagatggtacagggtgagttcacgccgtcccagcaggcggagcgcgctgccgctctggtttgccgcgaggcaggctttgacgagtccatgagccattcgttcatctccccgaagttctacgacatgatcggctgggacgagaacgacccgcgccgtatctccaccaccatcctcaacccgcttggtgaggatttcagcgtaatgcgcactaccgtgctgccgtccatgctggataatctggcgcacaaccacgcacaccgcaacccgaccgcttcgctgtacgagctgggcaccatctacaccccgaccgtcaaggacggcaaggctgacccggacgttctgccgcacgaggagaagatcctgaccctcggcagctacggccgcctgtcgttcttccagttcaagggtaccatcgaggcgctgctgcgtgagctgaatatcaagggcgcgtccttcgctcccgagaaggccaacccgtcctatcacccgggccgctgtgccaaggtgctgatcgacggcaaggagatcggcgtattcggcaccattcatccgaccgttgccgcacgctacggtctgtccggcgaggtactcgctgccgagctgcagatggacgcacttctggctgccatcgatccggagaagctgtatcatccgctgcccaagttcccggcttccacccgcgatatcgcggttctggttgacgatgccgttccggcagcctccatgcaggccactgttgagaaggcagcaggcaagctgctcgagtcggtcaagctgttcgacgtttacaagggcaagggcatcccggagggcaagaagtccgtggcgtattcgctgtccctgcgcgcgcccgaccgtaccctcaccgacgaggagtgcgacaaggcaatgcgtgccgcgatctcggcacttgagaccgagttcggcgctcagctgcgcggttaagttcctgaattggatagaaaaagagcagatgcttggcatctgctctttctttatggttttatactgcgttatccgagagaaccgtccggattgacataatcccagtcattggaataatcatgctgcgtccattcgacgattttgtcgcctgcaggcggcgcgttctttggctcgacactggattcggtcgtgctcagcgtgatatcgagcgacagaatgccggtgttcttggtgtggtaggtcacgctcaatttgcagttctgcacactgccggagaacgtcagcacggttttggtggtgttccagctatcggagcggctttcgagtgtgcccgagaacgagccgtccgccgtgttcagcgtgtagctgccggtcaggttgtcatacgaatcgctgctcagaccgttgatttttgcggtgtagcgcgagccgcttgcggtgaattgttcatcgcccagcaggttgttcaggcggtttacgtcattctttatgttgagataaaaatcctcccagccaagctcatatgcggtcatgttggattcgttcgcggcaacgatgctttcgcccaccgaggtaaaggtattgttcttcagaatcttcagattttcgctgaacagagtgccgaatgtgctgtccgcccagttgatgtgcagccacgcgccgttcgacagcgccttgagatcggcgtcgtccgttttgtccatcgccagaatctttgccacggcagggcacttcaaatacaggtcgccgctgtccgcgctgcataggagctcgagcttgacgttgctcagcgcactgcgcaggagggctgcctgtgcggcggtgagtacgtcatccgcctgcgaatcgccgaggaaataagacgccagcacgcgcagatcgaccgtcacggtcgcctcaatggcttgtccgttcgccagaatttcggttttgacatcaaccttgtaatccttgttgccgtcgatggtgtcgaaggcggtgtacgccgcgccgattgtcgccaccgtgcgcagcgtcttggcgttttcggtggatggctgtgccttgatccacttgttgagcacggtaaacttgctgtcaatgtcgtttacaagcgccgcgcggtcatacagcacggcggtctgcatattctgatcccactgcacggtcagtccgaacgcttccgcgaaaaagcgcaccggaacataggtgcgtccgccttttttgtacggcgcggtatcaagctgcacggttttgacggttttgcccgcgctgtccgtgacggtaagctgcttgctgccgagcgcaaacgacagcgtttcgccgccctttttcgcggtgattgctccggcgtcatatgtgacctcagcgccgagcgcctcggcaatggcgcggaagggaaccatcacgcgcccgtttaccttttccggctgtgcgtccgcaaagtggacatacgcgccgttgagctgcacggaaagctgacagcggagtttgtattcatcgccctctgtcatggcacgcgctgtatcacgatagcattcctctaaatcaccgtcccagccgaaggacagcccctccagatcgtcatacccccagtaatcgactgcgatctggggatctttatggatggcgtccaggtgctgccgataatggtcactgagcgtatcataatcgaaaacgccgtaggatgattcctgttccatgtactcctccgcactgtcatacccaaactgctgatacatcggcggtgtggtatccagtgcgagcgcgctcggcgccgagccggcgagcagcagcgctgcgagtgcggcagcggcaaaacggtttctctttttcatattgtgccccctcacataggtgttactaccattgtacaggaaaacagtgggatttgtctatccgcagtttggcgcaaattggcgggcaaaaaccgtcatactgtccatgcggacgcatagggtagagcaagggagggcactgctatgtttatcacgatcacacgcacgggtctgtgccgaattggtgtgggacttagcgtttttgcggttttgaccgcggttttcatcctgtttccgcgcgaaaatgctgagccgacagccgccgaacaggcggttcccgcgtctgtcagcgactggggattgtcgttccaaaccgagggtcagccgccggtcggcaatgtctccgccgaggaactgcggcagtacaacgcgttttacgtcggtgatacgagccaaaagaccatctacctgacgtttgacgcgggctacgagaacggctgcacgcctgctattctggatgcgctcaaaaagcataacgcgcctgcctgctttttcgtggtgggcaattttattgataccgcgccggagctcgtaaaacgcatggcagcggaggggcatatcgtgggcaaccatacgctgcaccatccggatatgtccggcattgcggataagagtgcgtttgcggcggagctgaacggtctcgaggagaaatacaccgcgctgaccggtcagccgatgcagaaattttatcgtccgccgcagggcaagttcagcaaggagaatctccggcaggcgcaggagctggggtataccacggttttctggtcgctcgcgtatgtggactggtatacggataaccagccgactgaggagcaggcattctccaagctgctgccgaggattcataacggggcgatcgtgctgctgcattccaccagcgagaccaatgcgaggattctcgatgaattgctgacgaagtgggaggaggcaggatatacgtttggtgctttgacggagctggcgcagtaattgaaaatggagaatggaagatggagaatgaatgtgtccgcgcacagcgcgacaattaaaatacggcgctccgcgccgttccttaattttcaattttccattctcaattctccattgcaaataaaaagacctctccaagtaaggagaggtctttttatttgcttttacggcatcatcacgcggccttcaaactcggcgcggcgcttgatgtccttcatgacggtatcgaactggttgaggtcgagcgactgtgcaccgtcgcagagggcgtgtgcgggatcgttatgcgcctcgatgatcaggccgtcagcaccggcagcgatggctgcgcgggacagcggctgcaccatatcacggcggcctgctgcgtgggacgggtcgatgatgatcggcaggtggctgaacatcttaaccagcggaacagcggagatatccagattattgcggatcagcttctcaaaggtacggatgccgcgctcgcacaggataacattggtattgccgcctgcgaaaatgtactcggcagccatgaggaactcctccatggtggcggacagaccgcgcttgaggaggatcggcttgttcgagcggcccagctccttgagcagcatgaagttctgcatgttgcgggcacccagctggatgatatcaacatctgcgaacaggtcgaggtgcttttcgctcataatctcggtgacgatcggcagaccggtctgacgctttgcctcgagcagcagcttgagaccctcggcctccagaccctggaacgagtacggggaggtacgcggcttgaatgcaccgccgcgcaggaaggaggcgccggcagccttaacgcgctcggcacactcgacgatctgcgcctcgttctcgaccgagcacggacctgccataacattgaagtagccggcgccgatcttgcggcccgcaacctcgatgatcgtgtcctcggggtggaatttgcggttgacggccttgaacggctcggtcacgcgctgtacacgctcgaccacgtcatacgccataatgtccccttcatcgagccgggtcgtgtcgcccatcaggccgaggataagtgtatctgcaccctgggaatagttgatccgcagccccatatccgtgaaatgctgcatcagtttgtcgacatgttccttgtcgctgtttcgtttgagtacaacgatcatttcagttcactccttcacaatgtgataaattttaagtaggatttacggtacgcttaaggcaataccgcataattgaacaagagtgatttgcgagtaaattttgcgtactgacgaggcgcggttttgcggtaatacttgatgtattaccgtgaaactcacaaaatttccgcaaagcaccgcggcagcgcgaccggagcctgcgcgaggagccgcggctttaattgtgcggtgttgccttgatttttcagtttttttacagcgtacgatttgaagtataccatatcagagggtaaaaagaaagagcgatttacgacaaatcgccctttgattttccacggtttttgcacatggttgcatgctgctaaccggatacttatgatgcttttgccgcttcgtcggctttcagctccttgtattttgcggttaccgcgctgcagaattcgtcccagcggccgctgttgatgagggtggacggacagattttgcccgaaaagtcctgatgctttttcagtgccttggacgggctcaggtcgtactcgatcagcagccgcgcacacagcttttcggtgttgatgagcgtctgttcgtagttgccgtccgagttgacgcacatttcaatgccgatgccgttcatgttgccgccgttcttctccatgccgtcgcctgcgtgataggcagtctcatcatccggcagatggtggtagatctcgtgatcgtccaccgtgtagtgccacgaaacaatgccctcctcggcgttggcgttctggtggatgaacgagttgtgcgcggccgcatttgcgccggtgccagtgttgtcggtctcgtggatgacgagatacttgatctcgcgcttctgtcccggacgggcgcgtgtgccctcgggaagaaagtcggtcatcaccgggatatcctcaatgtaggtcagaccggcgtcggtctgcggctcgcggaacacgatcctctgtgtcagcatgcccgccgcaaacgacacgatcatcagtccgactgtcagcatcaggctgacccgaagtcccttgcttttctttttgcgtgccatgattcaccttgtcttttcagaattacatcgtcttgctttttccattgtactacgttttacgcgatttttcaaaacaaagactgtaaactttttgtgatggcgacaccgtatacgcggattcggtatcaaattcgtaaaatttgcaagatgaacttgcatttgcactcggattcccttataataaaagttattcggagaggcgaagcctttcagcagaatttctttgaccgcccggtttctgcgcgaaaacggtgccaaggccatacggacagccgggtcaaatgccgaaactggcaactttgttgccttattgaattttataagttggctgactaaaagccgtgtgccgcgggcgcatcacacttgtgaaacgatcaataagagtacaaaggcaacaccgcacaattaagactgcggcgctttgcgaaaattttgcaccctgatttcgttgtgattttttgcaatacagcaagtattgccgcaaaaccacgccttatcagagcacaaaatttactcgcaaatcgctcttgcttcattatgcggtattgcctaaaagtaacgattcttgctatatagactctttcctcttccataaaacctacggaatgtgcagaagcatccgcaaaaagagaacgatcatcctcaagtgaaagcgtaccgtgtgtacccctttcgcctggggattttttggtattgtgaggatatgaaatgcagaacaagctcaaactttacgggttcaacaacctgaccaaggcgctgtccttcaacatttatgatgtctgctacgcaaagaccgagcgcgaacagcgtgactacatcaaatatatcgaccagcagtacaactccgaacgactgaccggcattctcgagcgggtaaccgagatgatcggtgcgcatgtgctgcacatttccaagcaggattacgacccgcagggcgcctcggtgacctttctcatcgcggaggagcacatgaagccggcccttgagccggataccatcgttgcacacctcgataagagccacgttaccgtgcatacctacccggagtatcatccggatacctgccttgccaccttccgcgtggatattgacgttgccacctgcggtgagatcacgccgctgtctacgctcgattacctcatcggctcgttcgattcggatatcatcaccatggactaccgcgtgcgcggctttacccgcgatatcgagggcaaaaagctgttcatggatcaccatatgacgtccattcaggactttatcgacccgaaaacgctcgagcggtacgacgcatacgacattaacgtgtaccagtccaacctgttccacacccgtatgctgctcaaggaggtcgatctgcagaactacctgttcaacaccgacatctatgagctgccgcccaagaccagactcaagattcactccgacctcagacgagagatgattgagatattttcgggcaagaacatctactgatttcgattgaaaatacattttcaatcgagaaagacaaaccgaacgatgttcggatttgtctcacaataaaatttgcgcgtcgcttcgcgcgaaagcgcagcatatcattctctgccgaaagaaggcatttttatggatcaatcccgtgcgccaatcatggaggcgctcgaaaacttcaaagacatgcgcattgtgccgttcgatgtacccggccacaagcgcggacgcggctcaccggaattaacgaaattcctcggtcagcagtgcatgacggtggacgtcaactcgatgaagccgctcgacaatctgtgccacccgaccagcgttatccgcgaggccgaggagctggccgcggatgcgttcggtgcggcgcacgccttcctgatggtgggcggcacgacgagcagcgtacaggcgatgattctgtccgtggtcaaacgcggcgacgagatcattttgccgcgcaacgtacaccgcagcgtcatcaacgcactcgtgctgaccggtgcgattccggtttacgtcaacccgcagatgaatgaccggctgggcatttcgctcggcatgtcagtcgcggacgtgaaggccgctattgagaagcacccgtccgcaaaggcggtgctcgtcaacaacccgacctactacggcatctgctcgaacattcgggaaatcgtaaggctcgcgcacgcggcaggcatgaaggtgctggccgatgaggcgcacggcacgcatttctacttcggtgaaaatatgccggtctccgcgatggcggcaggcgcggatttagcatccgtttccatgcacaagtcgggcggctcgctcacgcagtccagctttctgctgtgcggcccgtccatgaacgcggagcacgttcgccagatcatcaacctgacgcagacgacctccggttcgtacctgctgatggtcagcctggatatttcgcgcaagaaccttgcactgcacggcaaggagattttccgaaaagtcgttgacctgacaacctacgcccgcgaggagatcaacgcgctcggcgattactacgcctacggcagtgagctgatcaacggcgacacggtatacgacttcgacacaaccaagctggcggtaaacacgctggatgttggtctggcgggtatcgaggtgtacgacattctgcgcgacttttacgatattcagaccgagttcggcgatcttggcaatctgctcgcctatgtttcggtgggcgaccgtgagcgcgacctcgaacgtctggtagccgctctcgcggacattcgccgccgctacaagcgcgacaaggcgacgctcatgcggcaggagtacatctcgccgcaggtggttgccggcccgcaggaggcgttctacgcggacaagaaggccatgccgctcgaggagtcggtcggacgcatctgcgcggagtttgtcatgtgctatccgcccggcatcccgattctcgcgcccggtgagcgtattacccgcgatattcttgattatattcgctacgccaaggaaaagaactgcatgctgctcggcaccgaggaccccgaggtgaacaatctgcaggtcatccgcggcgttgtcagcccggaataaaaggagcgtttcactcatgcaacttacctttactgaaatgcacacgccgacggttgggctgcagatacaggtagaccgtcagctttacaccgaacagagcgattttcagcgcattgacgtgtttgaatgcgaggagttcggtcggtttctcacgcttgacggctacatgatgctgaccgagcgggacgagttcatctaccatgaaatgatggtgcatgtgccgatggccgtgctcggcgagaagatcaaaaaggtgcttgtcatcggcggcggtgacggcggctgtgtccgcgagctgtgccgctatcagcacatcgagcatatcgaccttgtggagatcgacgagcgcgttgtcgcggtctgcaaggagtacctgcccggtgtggcatgttcgctcgacgacccgcgcgtgcacattctctatcaggacggcctgaaatatatccgccggattgaggacgagtacgaccttatcatcatcgactcgaccgacccgttcggcccgggcgagggtctgtttacgatggaattttacggcaactgctacaaggcgctcaaggagtacggcgtgctcgtcaaccagcacgaaagcccgttctacaagggcgatgcactggcgtgccagcgggcgcaccgcaatatcgtgcactcgtttgagctgagccgtctgtttcaggcacatatcccgacctacccgtccggacactggctgttcggcttttcgtcgcgcggcgtgcatccggtgcgcgatctgaatccggactggtggaacagtctgggactggaaaccagatactacaataccaatctgcataagggcgcgttctatctgccgaattatgtgcagaagctgctggaaaaggtggaagaataacgtaatcgcttagaaaatcactatgggtttgattgggtgttcgcttggcaaacgggttcgccccttccgggcggcagcctttttctctgcaccggctgagcggggcgcgcgaactgcgtgagtgtgttcgcccctaacgggcggggaggttttcgctgaacctcagcggggagtgcgctgacgccgcgcgggcgcacaagagggtagacacctacggtttccaccctcttgtgaattacccctttcccttggagggtctggcgcagattgccgacatgtgaccgctgcgaaatgggggaacggcagaggattttttctctgctacggacggactaccttcggagtccatcctcttgagcagcctattcgcagtgtcggataccgtactgctacacaggcggtttcgtctgcgctgggtgcggcataacagtgccgcacgattcgtaagtctggaggttacggacagcacctacgaatctatctatttagtagcatttatcctcgcagatgccgtgcgttacaacgtgccaaggatttgcgcggcactgctatgccgcgccctgcgttgattaacccgcatgtgtagcagtacgctatctgtgaactgcgaaaaggcggagaaagacacgctgtggtaacccgactgccgttccccttttcctgcttacgcagtctaccgtctgcacccaagctatcccaacaagggaaacgggtgttcaaagagggtagaaaccgtaggtgtctaccctttttgcccccgccgcgggtgcggcgcagttccgttcgcttctcaagcggcagtttaacaaataaagaccattcaataaatctaaattatatatacagttaaaaatgaggaggaattaacaatgggaagagcattgatcatcggctgcggcggtgtagccggcgtagttatccacaagtgctgccagaacagcgacgtttttgaggagatcatgatcgcatcccgcaccaagagcaagtgcgatgccatcaaggagaagctggacggtacgaccgcaaccaagatccgcaccgccaaggtggatgcggacaacgtagacgagctgtgcgcgctcatcgacgagtacaagccggacatcgtgatgaacattgcgctgccgtatcaggacctgaccatcatggatgcgtgcctcaagtgcggcgtaaactatatggataccgccaactacgagccggaggacaccgacgatccggagtggcgcgccatttacgagaagcgctgcaaggacgagggctttaccgcgtacttcgactactcctggcagtgggcatacaagaaaaagtttgaggacgccggtctgaccgctctgctcggctccggctttgacccgggcgtaacgcaggcgtactgcgcttacgcacagaagcacctgttcgatgaaatcgacaccatcgacattctcgactgcaacggcggcgaccacggctatccgtttgcgaccaacttcaacccggagatcaatctgcgtgaggtatccgcaccgggctcgtactgggagaacggtcactgggttgaaatcccggcgatgagcatcaagcgcgagtacgacttcgatcaggtcggccacaaggacatgtacctgctccaccacgaggaaatcgagtctctggcgaagaatattccgggcgttcagcgcatccgcttcttcatgaccttcggtcagtcctatctgacccacatgaagtgtctggagaacgtcggcatgctgtccaccaccccgatcgagtttgagggccaccagatcgtgccgatccagttcctcaaggcgctgctgcccgatccggcaacgctcggtccgcgcaccaagggcaagaccaacatcggctgcatcttcaccggcaagaaggacggcaaggaaaagaccgcctatatctacaacgtctgcgaccacgaggagtgctaccgcgaggtcggctcgcaggccattagctacaccaccggcgttccggcgatgatcggcgcggcgatgctgttgaccggcaagtggaacaagccgggcgtgtacacggtcgaggagtttgatcccgatccgtacatggaggcgctgaacaagtggggtctgccgtggcagattaacgacaagccggtgctggtggactgatatgaaatttactgagcttcctacgccctgctacctgctcgatgaaaaccgtctggtgcagaatctggccgtcctgcgggacgttgccagacgcaccggcgcgaagatcctgctggcgcagaaggcgttctcgatgttttccgtgtacccgctgatccgggagtatctggcgggcacaacggcctccggtctgtacgaggcacggctcggtcatgaggaattcggcggcgagacccatgtctacgcgccggcctacgcggagggcgaattccgcgagattctggagtacgccgaccacattgtgttcaactcgttcacgcagtggaaggcctacggcagccttgcccgtgcggcagggaagagctgcggcctgcggctcaatccggagtgctccacgcagccgagcgaccacgcgatgtatgacccgtgcggtccggattcgcgcctcggcattacgatagagaatttccagccggagctgctcgacggcattgaaggcttccacttccacacgctctgcgagcagaattcggacgatctggtgcggactgtcgctgcatttgagcagaatttcggtcagtatatggacggcctgaaatggatcaatctcggcggcggccaccacatcacccgtgcggattatgatgtggaaacgctggtgcactgcattgattatctgcagaaaaaatacaaggtgcaggtttatctggagccgggcgaggccgttgtgctgaatgcgggctatctggtctccaccgtgctcgaggtgatgcacaaccataaggacattgcgatcctggatacctcggcggcgtgccacatgccggacgtgctcgaggtgccgtaccgtccgccggtgtaccgcggcggcgagccgggcaaaaaggcgttcacttatctgctgaccggccgatcctgcctcgcaggcgatgtcatcggcgagtattcgttcgatgtggcgctcggcgccggtgaacaggtcgtgttcgaggacatggcgctctacaccatggtcaagaccaatacgtttaacggtatgccgctgccgctgatcgccatccggcgcgccgacggcacggatgaggttgtgcgtatgtttgggtatgaggagtttaagcggagactttcgtaagttcctgccgggcggcagcctgtttctctgcaccggctgaccggggcgcgcgaactgcgtgagcgtgttcgcccctaacgggcgggatgttttcgctgaacctcagcggggggggtgcctacccggcgggggcacaagagggtagacacctgcggtttccaccctcttgtgaatcacccctttcccttggatagtctggcgcagattgccgacatgtgaccgctgcgaaataggggaacggcagaggattttttcttccgtgtctttctcaacctgttcgcagggtcagataccttactgctacacatgtgatttcatctaagcaggcgcgacataacagtgtcgcgcaagtcgtaagcacgttataatagacagggtctacgaagataaattgtaccaaacgcttaattcgtaggtgccgtgcgttacaacgtgccaaggatttgcgtggcactgtcatgccgcgccttgcgttgattaacccgcctgtgtagcagtacgctatctgtgaactgcgaatattttgcgaaacaaacgcaagagtaacccgactgccgttcctatttttcgaagcggtcgccggtctctgatttgcgtcaggctaacaaacaagggaaaggtaggagttcaaagaggaagggaaaccgcaggtgtcccttcctttttgcccctgcggcgggcgccgcaacgtccccgccgtccgcagacggcgaatccccccgctgaggttcagcgaaaaactgctgcccggatagggtgaaccgcctgcgcggttcaagtgccccggtcagccggtgctgaaaaggagccgcccgttaggggcgaaccgcctgcgcagttcgcgtgccccagagggtcggtgccggaaaacaggtatatcccttgacaaacccgaatttaacagctataatattaaagttaatacacaaatgccgtgaaaaagaggagtatttttcctttgcgcgtttagagagggtgcggtcggtgcaagcacctcggcggggaagaagaaggtcgctttggagcagaacagccgaattttcgttaagctgttccgtctaacccgcgttacggggcaacgagtgcgcgtctttacgcgaattcaggtggtaccacggagcatacttcgtcctgttgtcgggatgagtatgctctttttgtttgcacagaagtatcccgcatttatatcgtaaatcaaattgaaggagatagatcaatgagcgaactgcctaagacctacgacccgaaatcggtcgaggacaagctgtacaagttctgggtcgattccggcttcttccacgccgaggtcaatccggacaagaaaccgtacaccatcgttattccgcctccgaatgttaccggccagctgcacatgggccacgcattcgacgagaccctgcaagatatcctcatccgcaccaagcgcatgcagggctacgaggcgctgtggatgccgggcaccgatcacgccggtattgcaacccagatcaaggtagaggagaacctccgcaaggaggagggcctgacccgttacgacctcggccgtgaggagttcctgaagcgtgtatgggcgtggaaggacaagttcggcaaccgcatcatcagccagctcaagaagctcggcacctcctgcgactgggaccgcgagcgtttcaccatggacgagggctgctctaaggctgtccgcgaggtattcgtaaacctgtacaacaagggtcttatctataagggccaccgcatcatcaactggtgcccgcactgcgcgaccgccctgtccgatgccgaggttgagtacgaaacccagccgggcaagctgtggcacatccgctatccgctcgcggacggctcgggcgatctggtcgttgcgaccacccgtccggagaccttcatgggcgataccggcgttgccgtcaacccgaacgacgagcgctacaagcacctgatcggcaagacctgcatcctcccgatcatgaaccgcgagatcccgatcttcggtgacgagtacgttgacatggagttcggcaccggctgcgtcaaggttacgccgtgccacgacccgaacgacttcgagatgggtcagcgccacaacctcgagcagattctcgtgttcaacgaggacgcgaccgtcaacgcaaacggcggcaagtacgagggtatggaccgctacgagtgccgcaaggcggttgtaaaggacctcgaggaaggcggctggctggtcaagatcgaggaccacgagcacaacgtcggcacctgctaccgctgcggtactaccgttgagccgatgacctcggcgcagtggttcgtcaagatggcgccgctcgccaagcccgctatggacgttgtaaacgagggcaagaccaagttcgtgcccgaccgtttctccaagacctacctgcgctggatggaaaacgtacacgactggtgtatctcccgtcagctgtggtggggtcaccgcatcccggcgttctactgcgacgactgcggcgagatgaccgtctccaagaccgatgtatgcacctgcccgaagtgcggcagcaagaacatccgtcaggaagaggacgtactggatacctggttctcctctgcgctgtggccgttctccacgctcggctggccggacaagaccaaggagcttgactatttctacccgacctctacgctcgttaccggctacgatattatcttcttctgggttgcccgcatgatcttctccggtgtggagcacatgggcgagaccccgttcaagacggtttatattcacggtctggtgcgcgacgcgcagggccgcaagatgtccaagtcgctcggcaacggcatcgacccgctcgaggttatcgaccagtacggcgcggacgcgctgcgctttaccctcgcaaccggcaacagccccggaaacgacatgcgtttctcggatgagcgcgtacaggcgtcccgcaacttctgcaacaagatctggaacgcatcccgctttatccagatgaacctgaccatcgacaaggacaaggcagtcgagctgccgagcgaccttgccatcgaggacaagtggatcatcagcaagttcaacacgctggttgccgacgttacccgcaacatcgaccagtacgagctgggtctggcggctgccaagctgaacgacttcatctgggagaacttctgtgactggtatatcgaaattgcaaagacccgtctgcagaccggcgacgagaacgtacagaaggtgctgtgctatgtgctgagcggcgcaatgcagctgctgcacccgttcatgccgttcatcaccgagaccatctggcaggcgctgccgcatgagggtccgtccgttatggtatccgcatggccggagtacaaggacgagctccactttgccgctgaggaggcacagatggagagcctgatggacgctgtccgcgccatccgcaaccgccgtgccgagatgaacgtaccgccctccaagaaggccaaggtgctcatcctgaccgaaaagaaggacaccttctccgcaggcgcaggcttcttcccgaagctggcttacgcttccgagattgaactcatcgacgcggttccggcggacgctgccaagatggcatccgtagtcaccggcgacgcacagatctatatgccgatgggcgacctcatcgacttcgaggccgagcgggcccgtcttggcaaggagaagagcaaggttgaggccgacatcgacttcgttatgaagaagctgaacaacccgaagtttgtcgataaggcacccgagaaggttgttgcagccgagcgcgaaaaggccgaaaagctgcgcgagcacctcgcaaagctggaagagtcgattgcagcgctgaattaaacataaggcaacaccgcacaattaaagcggcggctccttgcgcagactccggtcgcgctgccgcggtgctttgcggaaattttgtgtcctgactttggcttcggttccttgcgcgagttccgtccgcgctgccgaagtttcacggtaatacatcaagtattaccacaaaactgtgcctcgtcagtacgcaaaatttactcgcaaatcactcttgttcaattatgtggtattgccttaaaaagagtggagtttctccactcttttttcttaacattttccccgaaaacacttgactgtaaacccactttatcccttataatgtaatcaatagaagggaaggtgatcgtatgaacatagcggaagcagagcgcaggacgggattatcccgggcgaacatccggttttacgagaaggaaggcttactcacgccgacacgcggcgagaacggctaccgcgattacaccgaggacaatgtacagacactgcggaagatcatgctgctgcggcggctgcgcctgagcgtgcccgacatccgcgccatcgagagcggcgagaaagcgctgcccgaggcggcggcaggccagctcgacgtattgcagggggacatccgcgagagcgaacaggcgtatgcgatgtgccgcgccatctgcgaggacagggcggagtggaacgggctggatgtagaccggtaccagtccatcgtgctgcccgcagacgacccgcgcgagaaagaccgcatcccgccggcaggctgtccgtggcggcgcttctttgcccgcaatgtggatgccggactgtatgggctgctgtggtcgatgctggcacagtgggtgttccgcatcaatccggagaattttatccagctcacggcgagtctggcgtggacgctcgcgtgcgggtatgccggctggctgctgacgttcgtgttcgagccggtgctgctgcattactggggcacaacgcccggcaagtggatcttcgggctgtccgtccgcgatgaggacggagaaaagctgtccatccgcaccgcatatgcccgtttgtggggcgtgttcggctacggcaactgctatgcgctgccgctcttcgactggtactacaattacaagtgctaccgcgcgtgcaaagaagaggagctgccgtgggatttggagaacggatgcagcatcgttgtccgcgagcgggaggtgcgctggtatcgcgtggcgctgtacctgctggtgctcgtggtgcgagcagccgcatattacggcattgacctgtacgccaagctgccgcccaatcgcggcgaaatgactcttgcggagtatgtggagaactgcaacgactgcctgaactataatctgggcttggcgccgtatgtccggccggacggaagctggaatagcgacgtgggaatgggcggcaggtatttcttctcgctgggcgatgatgtatccgatgtgacggtcaaaaccgatgcggacggctatgtgcagtccgtgacggtggtttcggattcgcagaacggctcgtgcggctatcaggagcgcatgacggtgtattacgcctttgcggccgcgtatgccaaatggagctggctgtatgccgaccacatgagggatgacatcattgacgacggctgggattatgatgcaccggatacgaaaaacgtcaaggaagccaacctcggtggactgaagctgcggtatgaatatgaatacagcaatacagataccgtaaacctgtatctcaatcagccgatgccgtatcattcggtgctgacgattgagaaagagtgaatgagttatcgtagggcggggtgagggtgccccgccctgcggacatttatcaactaaatccgtggaatcgaatattacacaggaggtaagccgccacgggcgcagcgcgaccggagcctgcgcaaggatagcgccattctccattctcaattttcaattttccattactcctgcctcctgacttctgcctttacaaaaggctttcttatttgcccaaagtgtgctatactaatctcacaaaaacatatagatagaggaatagccaatgaaaggaatcattcttgccgccggtaagggctcgcgcctgtacccgatgacacgtccggtatgcaaaccgctgctgccggtatacgataaaccgatgatctactatccgctggctgcgctcctgcaggccggtatccgcgatattctcatcatcatcccgcccggagaggaaggcccgttctaccgtctgctcggttccggcggccgcttcggcgtcaacatcacctacgaggtgcaggaggttgcacgcggcatcgcggacgcgctgctcatcggctcccagttcatcggggatgactcggtttgccttgttctgggcgataatatcttctattcccccaatttccaggactgtctggaccgtgctgtgcagcagaaatccggcgcttgcgtgttcggctactatgtcgatgacccgcgtgcgttcggcgttgtggagtttgatgatcagggccgtgctatttccatcgaggagaagccgcgctatccgaagtctaattatatcattccgggtctgtatttctacgataactcggttatggagattgcccgcgggctcaagccctcggcaagaggcgagctggagattacggatgtcaatatcgagtacatgaaacgcggtcagttgcacgttgaaaagctcgaccgggatttcgtctggctggatgccggtaccgccgacaacctgctcgaatccgcacaggttgtccgccgcgtgcaggatgagaccggccgctacatcgcatgtccggaggagattgcgtacgcgcgcggctatatcagccgtcagacgctgcttcgtcatgcggaagagctgaataagaccctgtatggccgttatctggaatgtctctaaaggagaatcgcaaatgcctgtttataccgaaaccaaaacctaccacaccaaggcccacatgggcatgatcgacgttaccgacgacttccgcgcagcggtgcagaacgcctgccgcaagaccggcatgaagtccggcacgatcaccggctttaccaccggcggtgttgccggtctgaccacgcttgagtttgagccgggtatggtctaccatgacctcaaggcggcgatggacgtcttttcgccctaccgcgatgagcagggaaacgtcatttactatcaccaccatgacacatggcatgatgacaacggttcgtcgcatatcaaggcggcgctgctcagcccgtttatcgttatcccgttcgtgaatggcgagatcaccatcggcccgtggcagaatctgacccttgtggagtgcgatacccgcaaccgcgtgcgggatattgtctttcaggtgatgggagaataattcctttctgcttaggaattgtaaaacaaagccccggtttcgtcgcttgacaaaaccggggcttcgcgctataatatagctgacaaacggcggctcttgtagggagagcagtcgttcctcagttcgatttttagtcgagaagaagccgctctcttttaactaccggagggcggttatttctttaagtatccgaggataccaaagataaccgtgcagagcaaatcaagcagtccaatgacttccagaattgtcatgcagatcacctcccttctttcgggaggaacaacctttattcaccgtttgctgccttgattatagcatatcgtaatatgtactgtcaataaaccgtccttttgggcggtttttgtgtttaacttctcctcacgcgccgcgcagccggaaagattagcgtccgctaactaaatagcttttcttttttcgataaatgtggtataatataagcgttcggaaaaatttgagtacggtttgggaatccctgtgccgtgcatagaaatggagcgacaaagcatgactaaaattgatattatttccggttttctgggtgccggcaagacgactctcatcaagcgtctgctggccgatgcgctcaagggtgagcaggttgttctgatcgagaacgagttcggtgagatcggcattgacggcggcttcctcaaggatgccggcattgttgtaaacgagatgaacgcaggctgcatctgctgctcgctggttggcgacttcggcaaggcactgcatgatgttgtggaccagtaccatccggaccgcatcctgatcgagccgtccggcgtcggcaagctgtcggacgttatcgctgcggtacagaacgcgcacctcgaggttcagctgaacagctttgtaaccgttgttgacgcgctcaaggccaagatgtacctcaagaacttcggtgagtttttcgagaatcaggtggcgcatgccggtgccatcctgctgtcccgcacggctgagtgcccggagaagcgcctcgacgagaccgttgctatgctgcgcggtctgaatgggcacgcccgcatcgttaccaccccgtggaaggatttgaccggcgagcagctgctctccaccatggaaggcagccgcgacctcgttgcggaggttctcgaggaaatcgcgcacgagccgcaccacgagcatcatcatcaccatgagcacgagcatgagcatgagcatgagcatgagcacgagcacgagcatgagcatgagcatgagcacgagcatcatcatgagcacgatgagcactgcacctgcggctgccacgaccatgaccatcaccacgagcacgaccatgaccacgagcaccatcatcatcacgaccacgacggtcactgctgctgcggtcacgaccacgaccacgatgctgacgaggtattcacctcctggggcaaggaaacgacccgcaagtacaccgaggacgagcttaacgcggcacttaccgcgctcggtgatgttacgctcggcaccgtactgcgtgcaaagggcatcgttccgtgtgcagacggcggcgagtggctgcactttgactacgttccgggcgcacccgaaattcgccgcggcactgccgattacaccggccgtctgtgcgtcatcggctccgagctggatgaggagcgcatcgctgcgctgttcggcgtaaacgaaaagtgaggtaaccagattatggctaacgaacccattccggtatacgtctttaccggctttctggagagcggcaagaccaagttcattcaggacattctcgcggatccgaactttaccgagaacgagcgcacggtgctgctgctgtgcgaggaaggcatcgaggaatacgacgagaagtggctgctgcactatggcaccgcgcttgtgccgatcgagtccgaggaccgtctgacgccgaatatcctcaagcgcgtggagcagaaataccagccggaccgcattcttgttgagtacaacggcatgtggaagctggaaaagctgatgcaggcatttcctgcccgctgggagctgtaccagatcgttaccacggtcgatgcgaccacgtttgagctgtattccaacaacatcggcccgatgatgttcgagcatatcaccactgcggatctggttgtgttcaaccgctgcacggatgagctgaaggacatgctgtacaagaagaatatcaaggcgatgaatccgcgtgcggcaatctatctggatgacgtgaacggcaattccgaggactacgcccgcaatatgccgctgccgtttgacgtggatgcggatatcatcgacatccagccggaggactacggtctctggtacatcgacgccaccagcgacccgatgaagtatgacggcaagaccgtccgctttcttgcccaggcctacgtcggcaaggatgtgcccgccggcagcttcgtgcccggtcgcttcggcatggtctgctgcgcggatgacgtcaccttcctcggcttcctctgccgctatcccgaccgcgatcagctgcataaccgcgactgggtcaaggtaacggcgtccatcaccgtcgaggagctgccgcagtaccgcggtcccggtccggtgctgcatgccatcacggtagaacccgccgaaaaggcgaaggaagatatcgtttactttaactgaatcttctccatgcaaaataaaaagagacgagcctgcctggctcgtctcttttctgtataaaagcgcactgaccgctcgattaggcctcgaacggtcagtgactaaaaatcgctaatcaattagggtctgactgcctgaacagcatcccttggatatattatacccgagcagccccggttttgtcaagtgcggcaaagccggggttttgctttgcatgcagcgattactgcctgctgattgctgatttctaattagaaaagtgtgtcccccgtcacacagcagtgacgggggacagagacaaaagggggggatacagacgattcataaactccatgaacgtcttttgaaagatcggtgacggcttgagggattagccgatgccaccgtacataacgccgaggatcagtgcaagaactgcacagataacgtatacccacttgccgagcgggaagaaccagccgccgatcggcttcttagcgccttcgttaacagctgcaagtgccttttccttgccgagtacccagaagaacataacgccggccagagcagcgccgagcgggcagatgtaaatggaaacaacgtccatccactgagaggtccacggctggattgcgatggaaacgaccagaccgatcacaccgatgatgccaacggctgctgcacgcttgaacttgaagtgctcctgcaggaaggcgatcggtgcctcgtacaggtttacgatggaggatacgcctgcgaacagtacgcagatgtagaagatcgcgccgatgatacggccggcaggcattgcgttgaatacgtttacgaggtaaacgaacatcaggccggggccgccggatacgtcgttgatgccttcgcccagaacaactgccattgccggaatgataacgaatgctgccagcagagctgcgatggtatcaaatactgcaacgttgcgtgcggaggacgggatatcctcgctcttggacaggtaggaaccgtagattaccgagccgttgcctgcaacggacagggagaagaatgcctgaccgaatgcaaatacccacaggtcgggcttagccagaccagccggattcagggtcagaatgtacttatagcctgcggatgcgccgggcagcgtgccgatgtagattgccagtacgaggaacagaccgaacagaaccggcatcatgaccttgtttgccttctcaatgccgcctgcaatgcccattaccatgatggcgagggaaacgaccagtgcaacgatctgccatacgccgttgccgatgccgaagaagccggccgacgccattgccttgagggcttcgggaagggtctcagcctccggtgcggtcatgccgaacgtgccgccgatagcgcccatatccgtgccgaggctgaacaggctgccggagagggacatgaaggtgtacttgaagatccagccgagaacgaccgtgtagccgattgccagcatcaatgcaccgatgatcgggattgcaccgatcgccttaccggatttctcgctgccggtgcgctccttggtacacatgccgaacgcaccaaccggacctgcagctgcacggcggccgagagcgaactcctcaataacgccggtactgccgatcaaaattacaaagatgaaatagggaagcaggaaggtcatgccgccgtacttctgcaccatgatcgggaaacgccagatgttgcccataccaaccgcagaaccgatacatgccagaatgaatccccacttactctggaaaccatctctctgttctaagtttttaggctctttactcattatcttacacccctttaatgtgtaaatggatagaaaaagggcgttctctttgccgcagaaaatgtttagttttctgggaaaaagaacgcctttgttctttgctttcctgtgcactttccacgcgacacaggttacgccctgattataaagttataaaaaggtcaggagaaattcctgttatgcaatgccgcagcgcctttgctgcagcattggcgggaataccgcacaatttatacaattatgcggtatcgcctttgacgaaaggatggaacaggggattatttctcttcgttcgggtacggctccaggaatgcgtggaagtgacgcatcggcagattgtgaccccaaacaatacgcatgttcggaatgttctcacgatcctcgtacagagccttaacagctgcgattacatagtccagatgctccttggtcagacggctgcggtcgattgcgaagcgaactacgttacatacttcagcctgctgctccggggtcttcaggtcatactccatggagtagtcgcccagctcggatacacggatgccgtagcggcggatcagctcaaggctgaagccctcaccagcgaaggtgtcgtggccgcgcttgccgtcgaagaactcatccatgttgatgtatacagcgtggccgcctgccggcagtacaacgcccttaacgccagcgtcgtagaagccttctgccaggtagttacactgagcaacacgctcgttcatgtagttgaagtcgcaggactcgtacaggccaactgccagagccatgatgtcacggccggacatgccgccgtaggaatcgttgccgtagcaggagatctgcttaaccttcagcagaacgccaacatcggtcttaacggtgccgtcttcgttgaagtcggagaagttcttccagaacaggcccttatcgcggaatgccagcatgccgcccatgttagcgtggccgtccttcttagcggacatggtgaatgcgtcgcagtaagagaacatctcggtagcgatctcagcgatggacttgtcagcgtagccttcctcattcatcttgatgaagtaagcgttctcagcccagcgagcggtatcgaataccagcgggatgttgtacttatgcgcaacgcggttgatttccttcaggttgcccatggaaacggcctggccgcaaaccgggttgttggtgatgcaggtgaagatcagcggaacgttctccggacctacgctctgaatcagctgctccagcttctcgatatccatgttgcccttgaacgggttcttctcgtaacggccgcctttcggtacttcccacagcagggtcttgttgtacaggttacgcggaatggaacccatctgcttgatgttgccttcggtggtgtcgaagtgaccattcgacggaatggtgaacttcttgcccgggtgacgcttagcaaggatgttgcgaacgatttccatcagaacggactcagctgcacggccctgctggatgataaatgcgttcgggcgctccatctgagctgcgccgccattgaacaggccgccttcgtactcgcacagataaacttcgtccatcatcttctcaacgtcgcggcaatcggtgcgaacgaggtcgatgatcttcttccagttcttctcgccgccgcgctcgaagatgtcgcggaaggtgtcgagcagaacgtaataaccggtgttgcggccgtaagcctcgtcgccgaggaacaggcttgcccactgatgattggtcattgcagtggtaccggagtcggacagcatatcaacggtcagcatgccggacgggaatgcgaactcgttgtaatgagtagcctgaagagcgcgctcacgctgctcaacggttacttccggaagatcacggactgcgtaagtgaaatgatgcggtgcgggtacgttcagcggatactgcttgctcataataaattacctccagttgtgtgttttggaggtaccccggttgtcaaagccggttttccggttccggctttgcttagcggacagcacctttctttttttgctgttttcttttctttttggtttgccttacggcaggagagcggttacctcaatctcgacgagagcgtccttgggaagtcttgcaacctccacagcggagcgtgccgggtagctgccttcaccgaagaaggtggcgtaaacctcgttcatcgcgccgaaattgttcatgtcgctcaggaagacggtagtcttgatcacctgatccataccggttcctgcctcagcaaggattgcctttacattggtgagcgactgcttggtctgtgctgcgatcccttccggaaaagcaccggttgcgggatcgatcggaagctgacccgaagtaaatacgataccgtttgctgcaattgcctgtgcatacgggccgatggctgcgggtgcgtgttccgaacagataacctttttcatttcctgctcagcctcctttcgtcctttcgtgagataaatttatcacttttaaaattctttgtcaagatgtatttgtgcaatttggatgaatgaataaaaaaatctcgcgtatttatcaatattatcaacaactattgtgaaaaatgataattttgaacagactttttgtacaaaaatactgcgtaaaatatttacttttttcacctcgcacttagaaaagtttattattttacagaacatggtaattaaagcgcgaatttataaaaaatttttgttatcatactaaaacaatgcgatgaagaattcatgaagaatcgcagggagagcggtactgccgcggaaaatgataaaaattccgccaccggaaaactggagcagggaaaagacatcccgcgtttgcacttcaaataaaagcctgcgtatgctataataaattggattacatttcacagggaggtgcaccgcatgccggacgacaatctcaccgcttaccgcggcggcaaggcgcttcgccgcggctggacaaccggctcgtgcgcggcggcggcctcgcaggcggcggctgtgctgctgctgaccggaatcgcgccgccggagattcacctgcacacaccgggcggcatcaccttctgcctgccggtcgaggacgcacatatgagcggaaacgcggctgtctgcaccgtccgcaaggattcgggcgacgacccggacatcacaaacggggtccgcatcacggcttccgtgcgccgaatcgaaaagggcgttaccatagagggcggcgccggcgtcggacgaattacccgtccgggactggcgatgccggtcggagaagcggcgatcaatcccggtccgcggcagcagattgcggacgcggtgcaccgggctgcagaacagaacggatacggcggcggcttttccgttaccatttcggtggaggacggcgaggcacttgccgcccagacctacaatggccacctcggcatcgtcggcggcatctcgattctcggcacgagcggcatcgttgagccgatgagcgaaaaggcgcttgtggacaccatccgattggagctggacagcctgtacgcgcagggacagcgcattgcgttcctgtgcccgggcaactacggtgcggatttcgcgcgggacacgctcggccttgacctcgaacacgcggtcaagtgctccaacttcatcggtgaggcgttcgaccatgcggcttaccgcggctatcccgagatcctgctggtcgggcacgccggaaagctggtcaagatggctgcaggcgtgatgaacacgcattcatcggtcgcagacgcgcggcaggagattttcaccgcgcatgcggcactgtgcggcgcaccgcgcgagacactcgaaggactgatggccgccatctcggtggacgcgtgcgtggagctgctggacgaggtaaatctgcgccggtccgtcctgtcgcgcatcggcagggaaatggaaacccgtatcgccctgcgcatgaaggggcaggcacgcgtggaattcatcatgtttaccggaaaatacggcgtgctggccgagtcggcgggcgcgcgcgcactctgtgagaggttgaaactgcaatgaagggtattttatatggagtcggcgtcggtccgggtgatccggagctgctgaccgccaaggcgatccggctgctgcgcgagtgcgatgccatcgccgcaccgaagtccgccgacggcagacagaccgcactggatattgcttcgccgcacatcgggcaggacaagacgatcctgctgttcgatatgccgatgacgtacgacaagcaggtgcggaacgccagccacgacgcggcggcagacgcgctctgtgcgctgctcgacgagggcaaaaccgtggtgtttctcacactcggtgacccgacggtgtattctacctactggtatgtacacaggcgcgtggccgctcgcggctatgctgccgagctggtgcccggcgtgccgtccttctgtgccgcagctgccgccatgggccgcgccctgtgcgaggacggggaaatgctgcacgtcattccggtcacgcacggcagggcagaggagggactttctctctccggcagcagggtgctgatgaagaccggaaagagtgtattggaggtccgcgaactgctccggcagcgcggcgaactcggcagcgcggtgctgatcgaacgcgtcggcatggacggtcagcggctgatcgaagatttagatgcgctggaacagccgagcggctatttctctattatattggtaaaggagcaaagcgaatgatctactttgtgggtgcaggctcaggggcgcccgatctgatcacggtacgcggtgcacgtctgctgagcgaggcagatgtgattgtttacgccggttcgctggtcaatccggcacttctggagtacaaaaaggacggatgcgaggtgtacaacagcgcgaagatgacgctcgaggaggtcatcgccgtgatggcgcctgccgcgaaggcgggcaaaacggtcgtgcgtctgcacaccggcgacccatgcgtttacggtgcgcatagagagcagatggacgagctggacaggctcggtctggcgtatgaggtctgcccgggcgtgtcctcgttctgcggcgcggcagcggcactcaaagccgagtacacactgccgaatgtcagccagtcggtcatcctgacgcgcatggagggccgcacgcccgtgcccgaaaaggagcagatcgaggcgttcgcggcacacggagccaccatggtcatcttcctgtcggcgggtcagctggcgcgcctgtccgagcggctgatcgcgggcggatatgcgccggatacgcctgcggctatcgtgtacaaggccacctggccggacgaaaaggtcgtgcggacaacggtcggtgaactcgccgcggccggtgcgcgggagggcatcaccaagaccgcgctcatcacggtgggcgggttcctcggcaccgagtacgagcgctccaagctgtacgacccgacttttacgactgaatttcgtgaggcaagccgatgaagcacgcaaaatttgtatcctttaccctgtgcggcgcacagactgtgcaaaaggcggtaaaactcctgccggatttccggtgtgagcggtacgcgaggacggcggatgcgtcgctctcgggcacgagcctgaaacgctttgcacagcaggcaatggtcgattgtgacctgatcgtgttcgtgggcgcgaccggaatcgcggtacgcgcagtggcgccgtatttgatgggaaaagcctatgatccggcggtgatcgtcattgacgagcagggaaagttcgtgattccgctcctgtccggacatctgggcggtgccaacaagattgcagaaatacttgcgcaaggtctgcaggctgtgccggtgctcaccaccgcgacagatggacggcaggtgttcgccgtggacacttgggcaaaagcacacagctgtgcagttctggagccggaacatattaaatatgtatccggtgcgctgctcaggggggaaaccgtgggcgttcgttcggattttccggtagacgggctgctgcccgcccatattgacctaaaaaaagacgcggaaagcgggttcacgattggattccgcacagacgcacagccgtttgcacacacgctgcatctcgtgccgcggattgcgtatctcggcattggctgccgcaagggcacgagcgcggatgccatcgagcagacggttcaggcggcacttgcatcgaaaaaactgccctggcaggcgatttgcggcgcggcgagcattgatatcaagcagaatgagccgggtttgctgctgttttgcgaaaagcacggactgccgttccgcacctttacggccgagcagctgcaggacgcacaaggcgaattcagccggtcggcgttcgtgcagcagaccgtcggcgtcgataatgtgtgcgaacgcgcagctgtgtgcgcagcacagaacggcacacttatcttgcacaaattcgcgcagaacggcgtgacggcggctgtcgccgtgccggactggcgcgtgacgtttgaagaacgggaggttgaagcatgaagctgtattgcatcggcattgggccgggcggcgaggagcagatgacgctgcgcgcggtgcgtgctctggaaaaatgtgactgtgtggcaggctacggtctgtacctcgatttgatcgagaacctcatttcggacaaggagcgcatcgaatccggcatgacacgcgaggttttgcgctgcaaagcggcggtcgaggcggcaaaacagggcaaaacggtcgcggtcgtgtcctcgggagacgccggtgtgtacggcatggccggcctgctgctcgagctttgcgagcacgagccgaacctcgaggtcgaggttattccgggcatcacggcggcctgctcgggcggcgccgtgctcggctcgccgctgacatgcgactttgcgtgcatcagcctgtccgacctgctcacgccgtgggacaagatcgagcagcgtctgcgcggcgcagcggctggcgatttctgcatcgtgctgtacaatccgtcgagcaaaaaacgcaccgaccatctgcgccgagcctgcgatattctgctggagatcgtgccgccggaaaccgtctgcggtctggtgcgcagcattggccgagaaggcgaaagctgcacgcttacaacgctcggtgagctgcgtgatacacaggtcgatatgctgaccactgtgtttgtcggaaacagccgcacgcgcgtgatggacggccgcatggtcacgccgagggggtatcgcggcgtatgaagctgatgattttctccggtacgacagaaggacatgatttgtgccgttttttgtcgaaaaataacgtgcaggcggaggtttttgttgcaacagagtatggcgcagcagtaatggagccgatggctggaatcacggttcacgagggccgtttagatgagcgggagatggaaaagcgattgacctcggacacgctgctcatcgacgcaacgcatccgtacgcggcggctgtgaccgacaatttgcgggcggcctgtgcgaaatcgggcgcacgctacgagcggctgctgcgacctgccctgccttatcagaactgcgaaatcgtgctggacacagccgctgctgttgactggctgaacgcgcatccgggcaaggtcctgctcaccacaggcagtaaagaactggaagcgtacacggcggtgcaggatttccaaacgcgcctgttcccgcgcgtgctgccgaccgcgtcggttcttgaaaagtgcgccgcactcggcttcccgggcgcgcacatcatcgccatgcagggcccgttttcgcaggcgatgaacgcggcgctgctgcgcgagaccggcgcaaaaatcctcgtgaccaaggacaccggcgtgtccggcggctttgcggagaaggtcgcggcagccgaggaggtcggcgcaaaggtactggtcattgcgcgtccgcgtgtggaaaacggcaaaaatcaggtggaaatgcagagatttatcacggatttgctcggtttacagccgaaaaaagtgcagcgcatattcaccatcatcggcgcaggcatgggcacggcggacacgctgaccggcgaagcggttcgcgcgttggaaacggcggaggcggtgttcgcgacaaaacggctggcggtactgtcgcccaaggcggaggtctgcgcgttctccgagctggctgagcgggcaatacagtgcacagaaaagcacatagctctgctcgtttccggcgacgtgggattcttcagcgcggccggaaaactgcgcgagcggctcctgccgtacggcggggtaacactcgtgccgggattgtccagtatgcagtatatgtgcgcgaaatgcggtattttatacgaaaatctgtgttttaagagtctgcacggtcgcacaggaaatattctcggtgccgtaagttaccacgcggcaacatttgcgctgaccggcggcgagaacaacgcgcaggcggtttgcaacagccttatggacgcgggattgggcgcgctgcccgttcatctcggggaaaatctcggcgcggaaaatgagcggattgtgcacggcacagccgcggagatcgcgcagctttcgtgcccggatttagcggttctgctgatcgaaaacccgcgtgcggcgaacaaaaacgaaccgattcgagatgaaatgctcacgcgcggaaaggtgccgatgaccaaggaagaggttcggtgggtgtcggtgaaccgcctgactgtccgaccgaccgacacggtctgggacgtgggtgcgggcaccggcgcggtcacgctcgagctggcgcgcaaggccagcgacggcacggtttacgccgtcgagcgaaagccggaagcggtcgcgctcttgcacgaaaaccgcataaaactcggcggatacaatgtgaaaatcattgaaggacctgcgccggaggcactggacaaccttccggcaccggactgcgtgttcgtcggcgggagcggcggcagaatgcgggagattctggcacttgccagggagaaaaatccgaaagtccgcgtggtcgtgaacgcgattgcgctcgagaccttgtttgcggcgcagacggccttgaaagaattggggttttctgacatcgaggtcacacagctggcagccacgcgcggtaagccggtcggcgcgtacaccatgctgactgcgaacaatccggtgtttattctgtccgggagggccgcaaatgacacaaaataatgcaccaagactgctgcttgcgggcaccggcagcggctgcggcaagacgacggtcacgaccgcgattctgcgggcgctgcagcgccgcggcgtaacactcagcgcgttcaagtgcggtccggactacatcgacccgatgttccatacggcggttttgggcgttccgagccgcaatttagacctgtttttcgaggatgaggccggtattcgcagtcagcttgcgcggcatatccagccggacggtctcggcgtgatcgagggcgtcatgggcttttacgacggcgtttccggtacgacggatacggcttcggcggcgcatctggcccgcgcaaccggcacgcctgcggtgctgatcgtgcggcctaaggggcagtcgctgtcgcttgcggcacagattcacgggttccgcacatttgcggaaaatacgcttgcaggagtgattttaaacggcgtttcggcgggaatgtactcgttttacaaacaaatcgcagagaaagcggggctgcctgtgctcggttttttgccgccggttccggaggccgaaatacctgatcgccacctcggtctggtgacggcggatgagctgtccgacctgcgtgagaaaattgatcggctcgcggatgcggcagaggaaggcattgacctccacgcattgtgtgcattagcacagacggcgaaaccgctgaccgatacgcacatgccgctcgctcgtgtgaccgattttccggtgcggatcgcggtagccaaggaccgcgcattctgcttctattatgaggataacttcgatgtgctgcgtgaactgggggcagagcttgtgccgttttcgccgctcacagacgagcgactgccggagaatatcgacggtctgtaccttggcggcggctatccggaattgtatgaaaaacagctttcagagaatgaaatcatgcgagattccatcaaaacagcgattctaaacggtttgccgacagttgcagaatgcggcggatttctttatctgctgcagtcgctcgacggcgcggcaatggcaggcgtgctgccgacttcggcgcacatgacgcacaggttgcagccgttcggctatgtcacgctcacggcaaacagtgataacctgctgtgcgaagccggtggacaatttcctgtgcacgagttccattatgcacaggctgtggataatggcacagattttcgtgcagtcaagccaaacgggcgcgcgtgggactgcggctttgcgtcggacacgctctatgcaggatttccgcatttgtatttccgtgcgaaaactgaaattgcagcgaattttgtccgaaaatgcgcggaaaggagcggaaaatgacacttgaacagactatttctgccatccggccgctggatgagaaaagcatgacggcggcgcgaaaccgttttgcaaatattgccatgccgctcggtggactgggtcttctgcaggacgcgattgtgcagcttgcgggtattctcggtcagccggtgccggatatttccagacgcgcggcggttgttttctgcgcggacaacggcgtggtcgccgagggcgtgacgcagtgcgggcaggaggtgacagccacggtcgcggaaaatatgggccgcggcgagtccaccgtatgtctgatggcaaaacagctcggaatggatgtatttccggtcgatatcggtgttgcacagccgataaagagcgaaaaagtgctgcaatttgccgttcggcgcggaactgcaaactttgcgcatgagcctgccatgacgcggaaagaggcgctcgaagcggtcgaaatcggcattaaaatggcggaaatgtgtgccgaaaagggatattcgctgcttattggcggcgaaatgggaatcggcaacacgactacgagcgcggcagtcacggcggcgctcaccggcgcggaggctgcggcggtcacaggacgcggtgcgggtctgtcaacggccgggctggagcgaaaaatcgcagtgatcgaggcggcgctggcgcttcacaaacccgactcgaatgactcgatcgatgtgctgcacaaggtcggcggtttggatatcgcgggtttgtgcggtctgtatctgggtgcggcggcgcagcgcattccggtcgtgctggacggcgtgatttcgtgcgcggcggcgcttctcgccgtgcgattgtgtccgcagtccgtgcattttatggtcgcagcgcacagatcggacgaaccggcgagcattttgctgctcgatacactcggcaagcggccgttcctgacggcgggcatgcacctcggggaggggacaggcgcggcggccggcgtggcgcttttggacctggcactggcgccatatcgggaaatggtgagcttcgcggacattggaatggaggcatatcagccgcaaaagtagttgtttgtctgacagatagcacaaattctttgcataaatattgtgtgtaacgccgataaatgctatctgcctgcattctttacaggaatgctgcgtgcagcaaaaagcaccgagcgttaactcggtgcttgcggttcggattttcagcatttcagggcttcatctgcgatatttgcagtgattttgttgtagaactcctgcttttgcgcatcgttttcaaacgctgagaacggcacaatgaccgcggagaattcatcaacaaaaatataataatgcttgtcgtcggttgcggtgcgctgaacagccgaatattggtaaacggtatcttcgttctcgccggacagctcgaattcgctttcacgcagcgtgagcgttttcggtccgcaaagctgcttgttctttgcgtttctgagaattttctcgatgtttttgatcattttatgacgcatatagcgcggtgtaccccagaagcagacgacagcgagcgcaacgtaaaccgcgatggaaaccggcgtgagcgtatgcagccagtacatgagcgcactgccgccgagaatgacaatagccgcagtggcgattctcatggtgcgaatactgcgttgaacaatcgcattattgttgtaataattcaaattaaaatcaatgaaatcctgtttggtgatatcgtaatgcagctccattttttcttacctcaacttactcggataaaattattgtatcgaaaatcagagcggattgcaagcctaattcagaaaggggagcgaaaatgctgattttagtgaccggcggagcggcttcgggcaagtcggagcacgcggaacggctggtgtgtgaaaaagcacagagccgattatatctggcgaccatgcagccgttcggcaagtccgcagaggcgcggattgcgcggcatcgggcgcttcgtgcgggaaaggggttcgctacggtagagagaacacttgatttagcgaatctcaggctctctcggcaatacgacggaattttgctcgaggatttgggcaatctgctggcaaacgagctgtttgcgccggaaggcgcaggcgcaggatcggcgttcgacagcattgttgcaggcgtggataatctgcaaaaatactgtgaaacgctggttatcgtttccaacgaaatctttgcggacggcgtgccgtatccgccggagaccatgcagtatattcggattttgggagaactgcaccaaaaattaactgggaaagcagacgcggtatatgaatcggtatgcggtattttgctgacggtaaaggagggaaaacagccgtgaaaagtgtaatcagcggacttttggtcgcgttctcaatgtactctgcgatacctgttccgcaggtgaactgggaaaaacagaccatgcggtgggcactcggcttcctgccgctcatcggtgtgctgatcggtgcgatagagtggttctggttcgcattttgcgtgcatttcggcgcggcaggcgtgttttacgctgtgatcgcagcgctgattcctctggcagtgtccggcggcattcatctggacggcctgtgcgacacctgcgacgcgctgtgctcgttcggcgaccgggaaaagcggctggccatcctcaaggacccgcacgttggcgcgtttgggccgctctggctgatggcattcctgctggccgaggtcgggtgttttgcccagatttacgaccggcctgtgcttcttccgctggcatgcacaggatttgctttcgcacgggcaatgggcggccgcaaggtggttgcgtcaccgtgcgcaaaagacagcggacttgcacatatctttgcgaaaaacagcgataaacgcgcggtatcgcgcatgttagttgctgaatttgttctgtttgcggtgcttctcggattgtggatataccgcgtaccgcacgcgcttgctgcggcgaaagtgctcgttatcgtgctcgttgcgtggtatgctgtgcatgagcacataagccgccgcgtgttcggcggtgtaaccggagacctggcgggattttgcatctcgctgtcggaattgatcacgcttgcggcagcagcgattggaggactgattttatgactgtgctcatcattggcggggcatatcaggggaaacgaaaagttgccgaaaacctgtatgcagacctgccgagggttgaaaatctgcacgaaatcgtgcggaaaatgctaaaggaagacaaagacccgctgtcgctcgcagatacgctgtgcggacacgttatcacctgcgatgagatcggctgcggcatcgttcccatcgaccgtgcggacgaaaactggcgtgaagcggttggtcgtctgtgctgtgctttggcacagaaagcagacgcagtcgtgcgcgtgatcgcaggcgtgccgcaattcatcaaaggagaacaaccatgacgataacccttgccgtgctgctcggcttcgcgctcgactggctgctcggagacccgaaaaaattgccgcatccggtatgtgcggtgggaaaactcatctcaggaaccgaaaaagttctgcgccgcatctttcccgcaacgcctgcgtcactgacattcgctggaattgtactctggctcatcacttgcggcgtgagctttgccgtgccgtttttccttttgcgctggctgtatcatgtgaacttctggctcggttttgccgccgaaacgctgctctgctggatgattttcgcacgaaaaagccttgcggacgccggttatcatgtctacggcgcggtcaagcagtcgctcgaggagggccgcaaggccatcgcgtggtacgtcggccgcgacaccgcagagctgtcagaggagggcgttatcaaggccgctgtcgagaccgtggctgaaaacctgacggacggtgtggtctcgccgctcgtgttcatgctcatcggcggagcgccgctcggcatgctgtacaaggcggtcaacacgctggattccatggtcggctatcataacgataaatacgagtatttcggcaagttttcggcaaaaatggacgatttcttcaactttatccctgccagactgtccgcactgtgtatgatcgccggtgccggcatgctgcacctcgataaccgaaacgcgctccggatttaccgtcgtgaccgcagcaaacacaaaagtccgaacgccggtcagaccgagtctgtgtgcgcgggcgcactgcacatccagctcggcggcgatgccagctacttcggcaaaatcgttaaaaaagccgccttcggtgatccgatgcgccgtgtagaccgcacggatattctcgcagcggtcgatctgatgacggcggcaagcgtgtttgcgctggtgctgtgctgtgtaatccgcctgatcgtaaaaagttaggatgctatgcgggagagaaaactcgcatttgaaaggatgaaaaaatgcttaattatgtccacggcggcgacatccaaacctacatcgaccgccacggcttcgcgccgctcgacctgtccgcgaacatcaatccgttcggcataccggacacggtacgcgcggccatgcacagggctgtggataactgcacgcagtatcccgacccgttttgccgcgccgcgcggcaggcgattggtgcgagagaaggcgtcaatccggattttctgtactgcggcaacggtgcggcggatgtactcgaccgattggcggcggtgctgaaaccgcgcaaggtacttctcaccgcaccgacctttgcggagtacgagcgcacgctctcaggtgcggagattcgggtgcataatctgcgggaaacggacggttttgcgctcacagagcgcattttggacgagatttcaccggatttggatgcggtttatctctgtaatccaaacaatccgaccgggcgaaccgcccaaccggaacttctgcgggaaatcgtccgaaaatgcacagaaaacggcgcaaaactggtcgtggatgagtgcttcaacgactttctgacagacgcagagcggcacacacggaaagacctgctggaatccaatcccggtctgattatcctgcgcgcgtacacgaaaatgtacgccgtacccggtgtgcgcttcggctggtgcatgacggcggacgcggcgttgattgagaaattataccatgccggacagccgtggaacgtgtcggtcatcgcgcaggcgtgcgccgtcgcggcggcaaacgagccggactgggccatcgaaaccgccaaacgcattgccgaggaacgaaaattcttatccgacggacttgcagcctgcggactgaaagtctttccgggcgaggccaacttcctgctgttccgtttaaacgataccggactgcacgagaaactcgccgagcacggcataatgatacgaaactgcgataattatcgcggactttcggcgggatactatcgcgttgccgtaaaaacgagagaagcaagcaagtgcttgctaaacgcaatcaaattgataatggaaaacgaaggtacgcgctttgtgcggatttgacagcgccgcgggcgcaagggcagtgacattttccattatgcgggaggtttgcaaatggcaaaaattatcatgatacagggcacctgctcaaacgccggcaaaagcctgctttgcgcggccctgtgccggattttccggcaggacggctaccgcgttgcgccgttcaagtcacagaacatggcgctcaactcgttcatcacggcggacggcagggagatgggccgcgcacaggtcgtgcaggccgaggcggcgggcatcgcgcccgatgtgcgcatgaacccgatcttgctcaagccgacaagcgacgttggctcgcaggtcatcatcatgggcgaggcgcagggaaaccgcaccgcgcgggagtattggggccgcaaaaaggcgcttttgcccattatcaaggacgcatttgacagccttgccgccgagaacgacattatcgtgatcgagggtgcgggcagtccggcggagatcaatctcaagcaggatgatattgtaaatatgggtctggcgaagctggtggatgcacccgttttgctggtcggcgacatcgaccgcggcggcgtgttcgcgtcgctgtacggcacggtcaagctgctcgaggaggacgagcaggcgcggattcgcggtctcatcatcaacaaattccgcggtgacgtggagattctgcggccgggtctgacgcagcttgaggatttgaccggcaagccggtcatcggcgtggtgccgtacggccattttgacatcgacgatgaggacagcctgtccgagcgtctggacacaaaggctgctcccgcactggtaaatattgcggttgtaaagttgccgcgactgtccaatttcaccgatttttccgcactttcgcgtgtatccggcgtgagtgtcgcgtatgcggacaaaccggcgcagcttgccggagccgacctgattatcctgccgggcaccaagtccacgctggcagacctgcggtggctgcgcgagagcggcatggaggcgcagattctcaaggcgcacgcggcaggcacgccggttttcggcatctgcggcggctatcagatgatgggacgcacggtctccgatccggacaataccgagggcggcggcagtctgcgcggcatgaacctgctgccgatcgacacggtgttccgcccgagcaagaccacgacgcagacgcgcggcacgctgctggagattgacggcgtgctgtccgatttgagcggtctggcggtcgagggctacgagattcacatgggcgaaaccgtgcgcgacgcgagtgcaaagccgctcgttcgattgcttcgcagggaaggagaaatcgaggacggctgtcagacggaaaacgccttcggcacttatctgcacggtgtgttcgatgcgccggaggcggcgctgcggacggcgcaggcactggcgaaaaagaagggcgtgacgctgaccggcgaagcactcgatacgcacgcctacaaggagcagcagtatgacaaactggcggattcggtgcgaaaatcgcttgatatggagtggatttaccgtataatggagggaaaagcatgacaggacttattcacctgtactgcggcggcggcaagggcaaaaccacggcggcggtcggactgaccgtgcgctgcgcgggccgcggaaacaaggtcgtgttcgcgcagtttctcaaggatgggacttcgggcgagtgccgcgtgctggcgaaattgcccgacgtgaccgttatggcagccaatccggtcggcaagttctcgttccgcatgacggaggcggagaagcgggagacagcggacgcgctcacccgcaccttcgatgcggcaaccggctttgccgtgcgggagcacgcgcggctgctcgtgctggatgaggtctgcgcggcaatctcgtgcggctttctggatgagaaaacggtcgtaaaattccttgagaccaagccggaaacgctcgaggtcgtactgaccggacggggtccgtccgaagcgctgcaggcacacgcggactacattacagaaatgaaaatgcagcggcacccgtttgagaagggcatcgctgcgcgggagggaatcgaattttgaacggatacatgaagccgcaggacattgaaaagcggtcgtttgaaatcatcaccgccgagctgggcgagcgcacgtttccggcgggcatcgccgaggtggtcaagcgcgtcattcacaccacggcggattttgactacgcggacagcctcgcgttttcgccggatgtgatcgaaaaggcaaaggccgcgcttgcggcaggggcaacggtggttaccgataccaatatggcgctctccggggtgagcaaggcgacgctggcaaagctcggcggaaaggcgatctgcctgatggcggatgagcaggtggcaagcgaggctaaggcgcgcggtgtcacgcgggcagtcgtttcgatggagcacgccgccaaatttgaaggcccgctcatcttcgccatcggcaatgcgccgactgcgctcatccgtctgcatgagttgattgaggaaggcattgtcgcgcctgcgctcgtcatcggtgtgccggtcggatttgtcaatgtggtcgaggcgaaggagctgttcatcggcggggacacgccgtatatcattgcgcgaggccgcaagggcggctcgaatgtagccgcgtccattgtcaatgcgctgctctatcagatggtacatcgagaaggcttttaattgctgtagccaaaccacggtttggccgacaagaggaacggaccgtaggccgttccaaagtcgtccgaaagttcccatacggaaactttctccctcttagggtataaaaaacggcgctatccttgcgcggcttctcggccgcgctgcgcagatacatgctcccggtttttatgaatcgcgttgcgattctattaaatgcgcgctatcgcgcgatatgctgaaaattttagcagatatactgttcggaagaataaaaaagagagagtttcaaacgaaactctctctttttgctacgaccaaagacctttttccctgcagtcggcaatgtatgcatcgatattgtccgctgtgatgacctcggaacccgagtcgatcaccgattcgacggatttgccctcgagtgcgtccaaagcggcctcgacagctttgtagcccatttcatagccctgctgggcaatatcgacagtcagctcgccgcggtcgagcgcttccaccgcagcctgattgccgtcaaagccgcagataacggttttttgataggcggcgctgttgttatcccagatgcacttgatggccgcaagcgccatatcatcgctggtaacgagcagcgcgtccacaccctgcggatacttctgcatgacagcctccatcgcggctgccgcacggtcgggctgcgcgtcgcagtactgcacctcgagcacagtgccgcccgcctgctccacggcgctgcggtagccgcgcagacgggcttcgtgcgtctcgtcgccctgtgcgccggtcaggatgacagcctgcggcttgtccgcgccgttcgactttgccttcttcatagcagctaagccgccggatttggctgctgcctcgttgccggtgccgacaaaggacagttttttgtccgaggtgaaatccgtatccagtgcgatgatcggcttgtctgtactttcggcggccgccgacaactgcccggactgcatgggcgaaatgacaactgcgtctacgctgtcatcgtcaagcgcggaccggaacagatccagctgttccgcgctgccgtccgccgaggacggaaactgaatgtcaatcgttacattcgggtgctcgctggcgcaggcttccgcgccagccatgacgttctgaaaatgctcgcccgcgtgcttgatgatcaccgctatatgatgggtatcgccggtgccggtcaggctgcaggcgctcagtcctgccgtgcaggcaaggcatgccagtgctgccgcaatcattctcctgttcatggtgtgtctcctcgttctcttttctgtcgggagctgctcatgctcttctcttgataatattttaacatattttccgcagagagacaaatagaaaaggcatgacttcaaatcatgcctttttctgtaacttttatcaggttatttgctcagacgctgctccatataattgtgcgcattcagctcaagcgtatcgttgagcggtacgagcggctcggtcttgccgtagcggcggtcgagcgcggtctgcaggatgaagtcgcacagcacgggattcttcggcagcagcgagccgtgcgagtaggtggcgaacacgttgttgtagcgtgcgccctcggtctggtcctcgccgttgttgccgtagcccttgatcatcatgccgagcggcgcgacgtcctcaccgagataggttttgcccgagtgattctcaaagccgaccacgatggagccgctgctctcgggcgttgtgcggtacatgtagttgccgatcatgcgctctttcgcgccgatggtgtgcacattgatcgcgccgatgaagtcgagctgcacgccgtcccacgttttgtaatactgaccgagcatctggtagccgccgcagatggcgagaaacaccttctcctcttcaacagcggtgcagatgtccttgcccttgccggaggcgaggtcgcgcagcagcacctcctgctcaaagtcctgtccgccgccgatgaagaaaatgtcgtacttgtccacatcgagcggctgaccgatcgagcactcgtccacattgacgctgatgccgcggctctccagacggcgcttcatcgtgataatgttgccccggtcaccgtacagattgagaatgtcggggtaaagatggcagatattcagttccattgcagtttcccccttattcgtagaacgccttaacgtcggtgtgcttgctgatctcaccgcgcaggtcgaacatggcagtgtatgtcggcataaggaatgccggtgtctcatccgagccgatctcggtcagcagcctgtcgtactcgcggataacctcgatacgctcgggggcaaagcctgcgtacttgagacgcagcgccatatcatccgcgcgcacgccggaaaccagtacgcgtgtaaagcgcacctgctggtcggcgagtgcctcgaagtcaacgtcccagatccagctgatgtccgtgccgtccgcgaagcggtcgttgagcaggaatgccagcttgtaattgccctcatcgtgcgcgatcaggttgatgacctgattgaagccggcaggattcttgaccagcatcatgcgcgcctgtgcctgaccgagtttgaactgctcggcacggccgaagccgcactcaaactgagaaagcgcgctgaccgcggtctgctcatcaatgccgacaacatgcgcgacagcggcttctgcggcggcgttgtagatgttgtagccacccggcaggttgacgtgtacctcgtgctcgtgaccgaagatgtccagtatgatgtcggacgagtccgcaccggtggcgagcaccttggtgacagcgacctgcggcgtctggcggtggtagccgcacttcgggcagcggaagccgccgagatggccgtaggtgatgtagtcgtactcatattcggtcttgcagtggatgcagtacggcgcgtcggacagctcatgagcggtctccttgtaaatcgggacattcacgccgaaccagatgatcttgttcggcacgctgtccgcaagggaagcggtgagcgagcagtccgcgttcaggcagagcgttgcattcggcacatgcgtgataccctcgcggatggcgttgagcgtgtgcgtaatttcgccgtagcggtcaagctggtcgcggaagatgttgttgacgaccagacattcgaccggcaggtattcgctcgttttgcggaaggctgcctcgtcgcactcgatgagcgcgtgcgtgtacgggcatttgccggacagcgtggaatgctgtgcaaataccgcgatgatgccggtcagcaggttcgcgcccgacttgttggagaaatatttgagtcccgcatcggcgaacgcttgctcaatcatgcgggaggtggtggtcttgccgttcgtgccggtcacgaccgtgacctttacgccgcgcgacagctcacccagaatatttttatcaattttcagtgccagcttgcccggcaggttggtgccgccgcgtcccagcctgcgcaggacagcgcccgatgccttgcacaccagcaccgccagtctggtttggagtttcattgttgtaacctcttttttcaagtcatataaaataagtatagcgcattttacggcatagtacaagatagcacaagaaagaaaatcgacaatacgcacggtcgcaggtcgttgcgtattgtcgatttctgtggtatactgtatgcggcactgttcgacacggaaaaagcggttagtcccctggcacatcaggggtacttctgtcccctgcttggaaggggggctgttttatgagtacatccgaagtattgcaactttgtttggtaatcatcggtatctgtaacttgtttatacaggcaaaaaagaagtaaccgccacgtctccaaaccaagcggttactcttttttagataatcttggggactaaccgttttgtcagcagtgccaccatttttgtgcttttattatagcactattttattttttcgtcaacctttatgcagcggtttacaggaacgctctgcggtcgttctgcagtttgccaagagcaacaattcggtgcgcatattgacatttttgtgtgcatatgctatcataaagcgcaataagggagtagtcggcgcggttgttccgccgcgcggcagagccaacatactggggaggacgctcctctggttttgcatgaaatgacgagacttatctgttctacgcggcagatgggtctttttttgtgcctgttttccgccggataaacgactgaggaggacaagaaaatgggtttgctggagttatttttgatcgcagtcggtctgtcgatggacgcgttcgcggtgtctgtctgcaagggactgagcgtgcgcacgctcaaggctaagcacgcggtcatctgcggactgtatttcggcggctttcagcttttaatgccgctcatcggctttgcactcggcgtgcgctttcagtcgctcatcacgagcattgatcactggatcgccttcgtgctgctggggcttattggcgcaaacatggtgcgcgagtcgcgcgagcacgatgacgaaagcgtcagcgattcgttccgctttatgaccatgctgccgcttgcggttgccacgagcattgacgcacttgcggtcggcgtgacgtttgcgttcctgcaggtcgatatcgttccggcggtgtcgttcatcggtgcaaccacgtttgtgctgtcgtgcatcggcgtgaagatcggccatgtgttcggcacaaagtacaagtcccgcgcagagctgttcggcggtatcgtactgattttgatgggtctcaaaatcctgctggagcatttgggttttctgggataacaaaaggcacctcaatgaggtgcctttttactgtctctatgcgttttcggtcgaaaatcattcggctgcagcctgcacgcccgccatatcctgcacggtcttgcaggtcagctccttgctgatcttgcccgcaaagccggtcagcgtcttgcccggaccgatctcgcacgccgaggtcagaccggcagccatgccggtcttcaccagctgcgtccagcgaaccggagagatcatgtgctgctcgagatgtgccggcaggtcggagcagtcgtaaaccttgccgtcgaggttggagtaaatatccatcttcggtgcggagaaggtaaagtccgcaacgtaagcgcgcagctctgcggcagcctttgccatcagcggggtgtggaatgcaccggataccgcaagcgggagcgcacggcgtgcgccggcagccttgcagttttcgatcgcctctgcgagagccgccttttcacctgcgataaccagctgacccgggcagttgtagtttaccggacggaccacgccggaggttaccttcgcgcaggcttcttcaattacgctgtcctccagaccgaggatagccgccatgccgccgtcgatcgagtctgctgcctgctgcatcagcttgccgcgcatggaaacgatcttcacgccgtctgcgagggaaacaacgcctgcagccgccagtgcggtgtattcaccgagcgagaagcctgccgctgccttgaattccacgcctgcttccttcagtgcagcccaggctgccatggaatgggtgaaaatcgcaatctggctgttctccgtgcgggagagcgtttccttgtcgctctcaaagcacagcttggctacatccagaccggcgccgtcgctcgcttcctcaaaaaccagcttggcagcctgcgagttctcataaagatccttgcccatgccgggggcctgtgcgccctgacccgggaaaaatgcaaaaccgtagttcacgtttcgttcctccaaaataataatcaaacgctgacagcaccgtattttaatagatattcttcacacaaagtgttgctaaataataacggtctgtcttgacaatttactgtgcttttattataatagtcggagaatactttgtcaatctaactattgtcgcttttccacgctttttgggagagcgatttggactttttaggagcgtggaaatcatcaacagtaaactgatcggcacgggcgcctgcattccggattttgtcctgaccaacgccatgctggaaaaaatggtcgataccaacgatgagtggatcgtgcagcgcaccggtgtgcgcgagcgccgcatcgcaaagaatacacatacatgggagctggcgctcggtgctgcacaggacgcactcgcggatgcaggcatcaccgcagaggagctggacctcattctcgtcagcacctgctcgccggataccaacacgccgaatacggcgtctatcctgcaggacaagctgggtgcgcgtcaggtcggcgcgttcgatatcaacaatgcctgcaccggctttgtctccgcgaccgacattgcggacagttacattaaatccggcaaggcaaagaccgtactggttgtctcggcggaaacgctttcgcgcatcgtggactacaccgaccgctcgacctgcattctgttcggcgacggtgccgctgcagccgtttatcaggcgactgaggacgaaacggtcggcattctgtccaccttcaccgcggcagacggttcgggtgcagagtacctgcacatggaagccctgccggtcgaggatccgctttccggtgaccgcacggtggacccgaaggcgcgtttcctgaaaatgcagggtgcaccggtcgtgcgcttcaccgcaagagccgtaccgcttgcgatcgacaccgcactcaagcgggcgggcgtcaccgcagaggaaatcgactgggtggtgccgcatcaggcgaatctgcgtattctggatgttattgcacgcagatatcatctgccgaaggagaagatctacgtcaatatggaccgtttcggcaatacctcgtcggcaagcgtgccgatctgcctgaacgaaatgcgtaagaacggcctgctacacgagggtcagaccattgtctgcaccggcttcggcggaggacttacttatggcgcttttgtgctgaaattgtaattacagtacaatattcaacagaaatgtacgataccagatattcagtgcaataacatttggttacatttcgtgaaaaatatgttataataacttgatagatttagaattacaagaaattacctgtataaaaggggagaatgacctatgaaaaccaagatcacagaacttctcggtatcgaatacccgatcgtgcagggcgctatggcgtggatcgcagagcatcatcttgctgctgcggtttccaaggcaggcggtctgggcattatcgcgggcggcgcggctccggtcgattacatccgtgaggagatccataaggcgcgtgccatcacggacaagccgctcggtatgaacatcatgctgctctccccgaatgcggacgatctggcacagttggccatcgatgagaagatcgaagtgctgaccaccggcgcaggcaatccgggcaagtatatcgcggactggaagaacgcaggcattaaggttatgccggtcgttgcttcggttgcactggcaaagcgcatggagcgcgcaggcgcggatgccgttatcgcagagggtatggaaggcggcggccacatcggtgagctgaccaccatgccgctcgttccgcaggttgtagacgcactgagtattccggtcatcgccgcaggcggcattgcagacggccgcggcatggcagctgccatgatgctcggcgctgaaggcgtacagtgcggcaccgtgttccttgcatccaacgagtgctatatctcggataagtacaaggagctcgtcctcaaggctaccgacatttcgaccgttgttaccggtcgtccgtccggtcatccggtgcgttcgctcaagaccccgatggcgcgcaagtgcctcgagctcgagaagcagaacaccaatgcctcccttgaggagcttgagaaggcaaccgccggttcgctgcgcaaggccgtgcaggacggcaactatgaggagggcacctttatgtccggtcagattgcgggtatgctcaaggagctgcatccgtgcgaggagatcctcaagggcatgaccgcgcaggcggaggaccttctgaaaaacgcttacaagagatttgaataagagcggagagtgaagggatacgaaaactcctcactcctgcctgtctatagaatggagtaaacaatgagcttagcaatcgtaaccggcggttcccgcggcattggcgcggcaatcgcggaaaagctggcgcaggacggcttcgacgttctcatcaattgtgcgtcctcggtcgaaaaggctgaggctgtggcggagaagtgccgcgcgcacggcgtcaacgcttatgtgaagaagtgggatgttgcggactatgacgcctgcagcaccgcgctcaaggaaattaaggaagagatcggcgtaccgttcgttctcgtcaacaatgcgggcatcacccgcgacggtctgatggtccgcatgaaggaggaccagttcgatgccgttatccgcaccaacctcaagggcgcattcaacatgctcagcctgtgcggtgcgatgatgatgcgcgccaagcagggccgtattatcaacatcacctcggtttcggcgttcaccggaaactacggccagatcaactacaccgctgccaaggcgggtatggtcggcatgaccaagaccgccgccaaggagctgggtgcgcgcggcattacggtaaacgcggtcgctccgggctggatcgccaccgagatgagcgacaaggtgcccgaggacatccgcgagaacgccaagaagcagatcgcgctcggccgtttcggcaagccggaggagatcgcaggcgtggttgcctttctggcttccgacgctgcaagctatatttccggccagacgatcatcgcggacggcggactttattaaggcatcaccggacaattcgcctgcggcactttgcggtaattttccgctctgatgtcgttccggatttttgcaatacacaaagtattgctgcaaacccgcgcctaatcagaacgcaaaattcctgcgcaaattgctcttgccgaattatccggtgaaaccttttttgctgcgtggaataaaaattgcgattagataaatgcgtgatattggaatgaaggagcaaatatatggaacgtgtagtaatcaccggcatgggtgccatcactccggtcggcaacgatgtgccgtcgttttgggagtcgctcaagaccggcaaatgcggcatcggtcccatcaccaagtttgatgtatccgattttaaggtaaagctgggtgcagaggtcaaggatttcgacccgacccagtatatggagaagcgtgaggcgcgccgcgcagacgcaaatgtgcattacgcaatggcggcagcggttcaggctgtcgagcaggcaggcctcaaggaaggcaatttcgatccctatcgcacgggcgttatcttcggctcgggcgtaggcggtctgcacgttgccgagcaggaggtcccgaagctgctcgaaaagggtcccggccgcgtttcgccgttcgctatcccggagatgatcgccaacatcgcggcggcgtatatctccatgcacttcggcttcaagggcgagaatttctgcccggtctccgcgtgcgcgaccggcaaccactccatcggtgaggctatgcgcgccattcgccacggctatcaggatgttgttgtctgcggcggcaccgagaacggcattatcccgatctcgatggcaggcttccagaacatgaaggcggttcacatgggcgaggacccgacggcggcttccatcccgtttgatgcacgccgttccggctttgtcatgggcgaaggcgcaggctgtctcgtactcgagagcctgacgcacgcacagcagcgcggcgcgaccattctggcagaggtggcaggctacggtgcctccggcgacgcttaccacatcaccagcccgtctccggacggcgaggcagcggcgcacgccatccgcggcgccatcgaggatgccggtctgaccccggctgacgttgactacatcaacgcgcacggcacctcgaccccgctcaatgaaaagtacgaaaccatcgccatcaaaaaggcgttcggcgacgaggcttacaacgtaaaggtatcctccaccaagtccatgaccggccacctgctgggcggcgcggctgcggttgaggccattgcctgcgttatggcaatccgtgagggcattgtaccgccgaccatcggctataaggagccggatccggagtgtgatctggatatcaccccgaacaaggcggttgagatgccgatcaatgttgccatctccaactcgctcggctttggcggccacaacgcctgcatcctgatcaagaaggtataaaaatggacatcaaagaactgaaagatatcgcgcttgagctgatggacgcactggctgcaaaaaagctgggcgaggtcgagcttgagctggataatgcaaaaatcaagatcaaggcagctgaaccggctcccgtgatcgctgcagcatcggtagcagcggcggcacccgcagcggcgccggcggcagcacccgcagcggagagcgcagacgcggcaccggcagaggagcagcttccggccggcacgcaggtgaagagcccgctggtcggcacgttttattcttctccgtctccggacgaaccgccgttcgtgctggtcggtcagcaggtgaaggagggcgataccctctgcatcatcgaggcgatgaagatcatgaacgagatcaaggcaccgtgcgacggcaaggtcatccgcattatggcgcagccgggcgatatggttgaatacaaccaggtgctctgcgtaattgaataagatataacgactatctgccgacagaacacggttttgtcggcaatagccttgctttttacagagagagggattataatatgctgaacaaagaacagatcatggagatccttccgcaccgtccgccgatgcttctggtggacgagatcctcgaaatggacgagaaccatgtagtcggtgcgctgcacctgaccggtgacgagttcttcttccagggccactttccgggcaacccgattatgcccgcggtgttccgtctggaggcgctcgcgcaggcaggcggcgtagcgctgctgtctctgcccgaattcaagggcaagactgcggtctacaccggcattgacaaggcgaaattccgcgcaatggcaaagccgggcgatacccttcgtctggaagtcaccttcaccaagcgccgcggcccgatggcagtagccgagggcattgcctgggtcggtgacgagaaggccgccgaagcggagatcaaatgcatggtcatcaatgactgaggcgggagagagctaatcgaatgtttcagaaggtactcattgcgaaccgcggcgagattgcggtccgcattattcaggcctgccgtgatttaggcattatctcggtggccgtttactccgaggctgaccgcgaagcgctgcacgcgcagatcgcggacgaagcggtctgcatcggtccggctcgtgcggcggacagctacctgaatatggataatatcatttcggcggcgctggcttccggctgtcaggccattcatccgggcttcggcttcctgtccgagaatccggattttgccgagcgcatcacgcaggccggtctggcgtttatcggcccgactgcggcaaccatccgtctgatgggagacaaatccgaggcaaagcgcaacgcgatcgctgcaggcgttccggtcgcgctcggcacggacggtccgctgcgcgattttgacgaagccatctccgaggccgagcgcatcggctatccggtcatgctcaaggcggcatccggcggcggcggcaagggcatccgcgtggcggagagcgtcaaggacctcaaggacgcgtacgacagcgcctctgcagaggctatcgccaacttcggtgacggccgcctgtacatggaaaaatatattcacaatccgcgccatatcgaggtgcagattctgggcgataactacggcaacgtggtgcacctgttcgagcgtgagtgctcggtgcagcgccgccaccagaagctgatcgaggaaagtccgtcggctttcgtcacgcccgagctgcgcgagaagatgacctcggcggctgttgcgctggcaaagcgtgtcggctaccgaaacgcgggtacgatcgaatttctggtcgataacgaccgcaatttctacttctgcgagatgaacacccgcattcaggtcgagcacccggtcaccgaggaggtcaccggcgtagatctggtctgcgagcagcttcgcgtggcggcaggcgagccgctgtcctttaagcaggaggatctgaccatccgcggtcacgccatcgagtgccgcatcaacgcggaggacccgtcgaggaacttcgcgccctgtccgggcacgctggtgtccttgcatctgccaggcggtcccggcgtgcgcgtggattccgcggcttatcagggatataagattccgccgttttacgattccatgatcggcaagctgatcgtctacggcgccgaccgtgagcaggccatcgttcgcatgcgccgtgccctcgcggagatgctgtttgagggcgttgtgaccgcaaccgactatcagatgcacatcctgtgctcgaaggcgtttgtggaagcaaactttaatgttaattccatcgcaaacggcgattttgactaaatcatttattatggtataatagatttagcgcaagtatagttgaatccgaaggtcttacaaaatcagcgtattttgaaaagcgaagtttttgtaatccgaaggatttcagaggcagtaccgcacggttggacaagagcgatttgcgagatggtttgttcactggtgcggcgcggacttgcagcaatactttgtgtattgcaaaagtacgcaacaaaaccagggggcaaaacagccgcaaagcgccgaaggccaatcgtgcggtactgcctccaaacgaaaggggagttacgcatgggtctgatcgacctgtttcaaaaaacacgcgagacctctatggaaatgaaaccgcaggaggacgaagcggccaaggtcgtaacctgcaagggctgcggcgcagaactgaaggcgtatgcctacggcaagaatctgtatgtgtgcccgcactgcggacgctacggacgactgctcgcgcgcacgcgcatccgtcagatcgcggataaggacagctttgaggagctgtacgccaatctggcaccggcggacccgatccacttcccgggatacgcagagaaaacggcagagctggctgaaaaggtcggcatgccggacgcagtcaagaccggcgtgtgtaagatcggcggcgtggaaaccgcgatcggcgtcatggacagccatttcatgatggcgtctatgggttcggtcgtcggtgaaaaactgacccgcctgttcgagtacgcgaccgaaaagggtctgcctgtcgtgctgttcacctgctccggcggtgcgcgcatgcaggagggcatgttttcgctcctgcagatggcaaaggtgtccgcggcggcgcgccgtcactcggacgccggactgctgtatatcaccgtgctgaccgacccgaccacgggcggcgttaccgcgtcgttcgccatgctgggcgatattatcctcgcggagccgcgcacgaccatcggctttgccggccgccgtgttatcgagggaaccatcggtcagaccctcccggacgattttcagtcctcggagttcttgctatcgcacggtttctgtgataaaatagttccgcgtaatcaactcagagaaacgctggaaaaactcttgaagctgcactgcggctccaagtccaagaaatggcaggtgtggcgtcgtgactaacaaacccgcaagtgaaaaaatgcgtatcatccacgataccaagcgcccgatgatcacggattatatcaatgaactgttcaccgacttcaccgagctgcacggcgaccgctatttttcggacgaccatgccatcctcggcggcgttggctacttcaacggcacaccggtgacggtaatcggccaccgcaagggccgcaccattgagcagaatatggacgccaacttcggtatggcgcacccggagggctatcgaaaggccctgcgtctcgcacatcaggcggagaaattccaccgcccggtcatcaactttgttgacaccggcggcgcgttctgcggcgttggcgcggaggaacgcggtcagggcgaggccattgcccgctgtttgtatgagtttatcgagctgaaaacgcctgttatctctatcgtgacgggtgagggtggctccggcggcgcactggcgctggcggtggcagaccgtgtgctcatgctcgagaacgccctgtattcggttatttcgccgcgcggctgcgcgtccattctctggaaggaccccaagcgcgaggcggaggcagcggacacgctgcatatcaccgcgcaggacctgtacagcttcggtatgatcgaaggcatcattcaggagggcacatcctccgcacagcttatccgcaatgtggcgcgcacgctgcgcgaccagcttgccgagctggatgctgagtcggacatcgacacgatgctgcagaaacggtatgaaaaattccgcagagtcggagttttcagaacaataaatcaagaaagtaatgaaggagtgtaaatcccatgtttgaaaaggtatgtgaaatcctggcagacaagtttgacgctgatgcttccaccatgaccatggacaccaaggttaaggaagacctgaacgcagactctctggacgttgtagagctgatgatggacctcgaggagaacttcggcgtaacgatttccgacgaggaagctgctaagatgagcaccatcggtgacatcgtaaactacatcgaagcaaaccagtaaggctttgcttcgattgaaaggccgttggcctttcaatcgagggggacgtaccgagccgttggctcggatacgtcctgtgcgggattctgcgcgtccgcctttggcgggcacacagaatccctttcttgtataaaaagtcaggcgcatgtcctgactttttatgcgtttgcgggcaaacgcgatggaatccgcgcttacgcgcggtccgctgcggcggagccaatggctcggatttctatgcgaaatcctgccatgcgggtgcggtttgcaagcaaaccgggattgaatcgcgctgtaagcgcgaaaaagccactgttccgtgaacagtggcttttttcattcgttttccgttactgagccgaaatggtaacagtcgaggtggtattattccaatccacggaaaagccgagcgcgaaaacgaggtcgcgcagcttgaagtagttgttgccgccgatggagtaggcggtgagggaaagcggctttccgtcgaggtagacagcggcgctcgtgagcgaggcggccttattgccggcgggcagggcagcctgttcgccgccgaccggcgtgtatgcggtcttgctcgtcaggtcgatgcgctgctgggcggcgttccatgttaccgcaaactcgctgtccagacccttgagggcagcggcgaggtcgcgcagcttgaaatagttgctgccgttgatggtataggctgcaagattggtctttgcaccgttgagctcgaccttgtgcttggaaacatatgcagtcggattggtgagcgtgcgaagggaagtgatggtgtcggtcagcgatgcgcgggcggagcgcacctccggcacattgtatgggctttcccagaaggagtagtgctcccaggtcatacccttggtgaaggcaacctgtgcggcacttagctcgtgataggtcacgctttcaccgttgagcgtacagatatggttaccggtatcgtcgtcgatggcatcggtataggtcagcgcggtgacgatcttgcggccctgcttggtcagatatttgacggggaagccgttcattatttcgtgcccgtccaccagataggctttcgtgtcgtcaacatagaaatctgcgcacggcgaaacatccgtggcgaaattgctcacgccctccggaatatccagcgcgtagattttcccatccgcatacgaatacatatgctgcccgtccagacctgcgccgcagtacagctctggaatcttatcgccgtccatatccaccagctttgccatcgagagaccagtcagcagtcccttgaagccatcgtccgtgcgagcagcggccttgccgtacttgttctgcagggtggtgatctgattcagatacgccttagcgccctgcggagacagggaaccgaggtcagccgcgcctgcggcgccgactgccatcgcgccggtcagtacggtgcagagcattgcctttccgattttgttcatagagattctccttccttttatcagacgcttgcgtcttttctttattgtacggcaggagtaagcctgcgtcaaccggaaaacatggggagatttctcagttcggtaaaatattttacaatttagagcggatatatcgccgtaattttgacgataaaataggtggaaaatgaacgaaaaaacgggtataataaattctgtacgaaaataatcccgctgatggaggaatagaatatatgatccgtaacgatttacgcaacatcgccatcattgcgcacgttgaccatggcaagactactctggtcgatcagatgctcaagcaggctggcgctttccgcgaaaatcaggtggtagaggagcgtgtcatggactcgggcgacatcgagcgtgagcgcggcattaccattctggcaaagaacacctctgtacattacaagggcgtaaagatcaacatcgtagataccccgggccacgccgacttctccggcgaggtagagcgtatcctcaagatggtagacggcgttgttctgctggttgatgcagcagaaggcccgatgccgcagacccgcttcgtgctgcagaaggcactggagttcggtcacaagatcatcattgcaatcaacaagatcgaccgtccggacgctcgcctcaacgagattggcgacgaggttctcgagctgctgctcaaccttgatgcgaccgacgagcagctggacagcccgatcgtttactgctccggccgtgcaggcaccgcttccatgtccccgaacgtggagggcaaggacctgaccccgctgttcgagcagattctcgagcacattccggcgccgcatgttgataccgaaggcccgacccagatgctcgtttcttctattgactacaacgagtacgttggccgtatcggcatcggccgtatcgagcgcggctcgatgaaggtaggtcagcaggttaccgtctgcgactaccacggcaacaccaagccgtataacgcaaagttggttaccctgtactccatcgaggagctgggccgtcagccgatcgaggaggcacaggcaggcgagatcgtttgcttctccggcatcgagggcgtaaccatcggtgagaccctgtgcgaccccgagcacgttgaggctctgccgttcgttaagatttccgagccgaccgttgagatgacctttatggtcaacgactctccgttcgccggcaaggaaggcaagtttgttacctcccgccacctgcgtgagcgtctgttccgtgagctgctcaaggatgtatccctgcgcgtaaacgaaaccgacaccaccgacgcattccgcgtttgcggccgcggtgagatgcacctgtccatcctgatcgagaacctgcgccgtgagggctacgagttccaggtcggcgcaccgaaggcactgctcaaggagatcgacggcaagacctgtgagccgatggagcgcatgatcgcggacgttccgtccgatgcagtcggcgcgatcatggagaagatgggcgctcgtaagggcgagctggtttccatgaacccgaagggcaccgaccgtatgcgtctggagttcattattccggcacgcggcctgtttggctaccgcaccgagttcctgaccgataccaagggcgagggtgttatgtcctccgtattcaacggctatcagccgtacaagggcgatatccagaagcgcaccaccggttctctgatcgcgtttgaggccggcgaggctgtcggctacggcctgttcaatgcacaggatcgcggcccgctgttcatcggccccggcacgatggtatacgaaggcatgatcgtcggcgagaacccgcgcggcgaggacatggctgtaaacgtctgcaagaagaagcagctgaccaacatgcgtgcatccggctcggatgatgcgctgcgcctgattccgccgcgccagatgtccatcgaggcggcactcgagttcatctccgacgatgagctgcttgagatcacgccggagagcatccgtatgcgcaagcgcgttctgtccaacactgagcgtctgaaaaagaccaagggcggcaagaagtaattgtggcaacgccacacggttgcatcttcggcgctttacggaaattttgtgccttgatgttgttccggctttttgcaatacacaaagtattgctgcaaagccgcgcctaatcaagacgcaaaatttgctcgtaaatcgctctcgatgaaccgtgcgtcgttaccactggctacgccacaattacgtttctgtgcggattttatgcacaaaagcactcatttcaccctgttatcaaaaataaagatatataaaggagaattcccaccatggctatcaaggaagttctgcacactgatctcgcaccggcagcagtaggcccgtactctcaggcaatcgctgcaaacggtttcgtatttacctccggtcaggttccgatcgacccgaaggcgggcaagattgtagcaaccaccatcgaggagcagaccgagcaggtcatgaagaacctgcagtgcgttctggcacagggcggcgtgtcctttgaccgtgttgtcaagaccacctgcttcctgtccgacatcaacgactttgctgcattcaacggcgtgtacgcgaagtacttcccggaaggcgctccggctcgttcctgcgttgaagtagctgctctgccgctcggcgctaaggttgaagttgaggttatcgcagttcagggctaaaagctaaccctaaaagactcgaaacgtatgtttcgagtcttttttgtgcagtaatggagaattgagaattgagaatggagaatggaaaatgaacgtggaatgaaacgtgttatcgtatttttatccggaataatcgtcatgtaacgccaaatcgtagggtgcggcaccttctcttgcccttcgggcaattcaccttgccgcaccctacggtaaggctatctgaaacgatgttattttctgcaaatgctttatctaacactcattttccattttccattctcaattttccattacttgatttcccaccaaaatgcttgctttgcggcctttgtatgcaaacggcgaaaaatattatgcggtgagaagaaatttatcgaaaaatgataatgcaatttgcggcatactgttgtataataaagctatatcggaaaatctggtcgtatgacccttgagaaacgaaaggatttctgcgatgaataaagtaaatgccgtcatggttggcggcctgtttgacgaaaacggcatttctgcttttgcgcgtccggtgctgttcggcactgcgggcgatgcaatgcgggatgcgttgcctgatgcggtggaggcgtgcttctttgcgcatgacgacagagagtctgccgttgccggcgcacaggacattgcgctcgatgctgcaaatcgttttgcctcgctggctgcgctgccggagagcgagcacgttctggtgctggcggctccgtttgcactggccgaggaggacgctctgttccatctggcggagacgcacctgaacaccggttacggcgtcagcgtactgtctgccgagcagcagggctttgatgcggaaggtcagcctctgccgagagacagccgctgctatgccgccatgttcacttgggatatgctgaaaaaggcactcgcgagcggcgctgatacgctcgacggcctggttgcggcggctgttgcagccggtgcgcagaagggcattgctatcaccaacaagatttacgtcatctgcgacggcactgccgcctttatggcgcaggtcgagatgatgcagcgtgtcaactacggcctgattaaaaagggcgtgcagatcttcgatctgaccagcacctacattgcgccggacgctgatattgctccgggcgcgaccattctgcccggctgtcacatccgtcccggctgcaaggtcggcgcgggcgcggtcatcggcccgaacaccatcctcgaaaaggccgagatcggcgcaggcactacggtaaacaattcgcaggtttatgaatccaccgtcggcagcaataccacggtcggtccgtttgcctatatccgcccgcagagcgtggtcggtgacggctgccgcatcggcgatttcgtagagctgaagaagtccaccatcggcaacggcaccaaggtttcgcacctgacctatatcggcgacgcgaccgtcggcgagcgcgtcaacttcggctgcggcacggtcgttgtcaactacgacggctatcacaagtaccgcaccgagatcggtgacgactgcttcatcggctgcaataccaacctcgtttcgcctgtcaagctgggcgaccgtgcgtttacggctgccggtacgactgtcaccaaggacgttcctgccggtgcgctgagtgttgcacgttcccgccagaccaatcttgagggctggaacgaccgccgccgcgccgcacacgagaagaacgaaaagtaaatccataaaacgtatataaatccacacggaacaaaaaatatatttatatgacggaggcaaatcaatgatttctcacggaaaaaacatcaaaattttctccggcaactcccatcccgcactggcgatgcagatcgcttctgcgctcggactgccgatcggcaaggctgccatctctaccttcgctgacggcgaaatctcggtttccatttcggaatccgttcgcggctcggacgtgttcctcgtacagtccacctgcggtccggtaaacaacaacctgatggagctgctcatcatgatcgactcctgcaagcgtgcatcggcaggccgtatcacggctgtaatcccgtatttcggctacgctcgtcaggaccgcaagagcaaggcgcgtgacccgatctccgcaaagctggtcgcaaacctcattactgctgcaggcgctgaccgcgtgctgaccatggacctgcacgctgcacagatccagggcttctttgacattccggtggataacatgctcggttcttccgtcctgatcccgtacattgcgggcaagttcggcgtcggcaccgatgataccgttatcgtttctcccgatctgggttcggttacccgtgcccgcaagttcacccagaagctggatatgccgcttgccatcatcgacaagcgccgtccgaaggccaacgtatccgaggttatgaacatcatcggcaatgtagagggcaagaagtgcattctggttgacgacctgatcgacaccgcaggcacgctcgtacacgcagcggacgctctggtagagcgcggcggcgcgaccgaggtttacgcatgtgcaagccacggcgtactgtccggtccggcgatcgagcgcattcagaacagcccgatcaaggagctgaccatcctcgataccatcccgctgaccaacgacaagaagctggataagatcaacgtcctgccggttgcaccggtgttcaccgaggcgatcgcgcgtatctacgaggaaacttcggtttcgaccctgttcgattaagattttgcatggaaaagagctgctgcatgggtgcagcagctctttttgtatatatttcctgcaccgacaagctgggggacacgaactgcgcaggcgtgttcgcccctgacggggcggcagctttttcagcaccggctgagcgggggagacgaactgccgtaggcgtgttcgcccctgacgggcggcttcttttctgcaccggctgagcggggtactcgaactgcgttagcgtgttcgcccctaacgggcggagagttttccactgaggttcagcgggggagttgcgctctgcggagcgcgggagactgccgcgcccgcggcgggggcaacgccgtacccacggcggtgggcaaaaaggaagggacacctgcggtttcccttcctctttgaactcctacctttcccttgcttgattgcccggcgaaaatcggagagcggcgaccgcttcgaaaaggggaacgacagaggatttttcctaccgtgtctttcgaaacctgttcgcagggtcagatagcgtactgctacacagatcggagagtctgcgcaggtgcggcataacagtgccgcacaattctttagcgcgttattactgacagggcctgcgaagataaattgtactaaacgtctaatccgtaggtgccttccgtaatctccagactaacgacttgcgcggcactgtcatgccgcgcctgcgtagagcagcccgtatgtgtagcagtacactatctgtgaactgcgaatatgttgcgaaacaaacgcaacggtaacccgactgccgttcccttgtttcgcagcggtcacatgtcggtaatctgcgccagactcggaaacaaagggaaacgggagttaagagggtagaaaccgtaggtgtctaccctcttgccccccgccgcggggcgcggcacgctcccgccgcagcggcggcgcactcctcgctgaatccagcggaaccaatcaacggcttgcagcaatgatagaaagaggtaatccatgaaactattagtcatcggcgatgtggtcggtgaggcgggtatcgacgcgcttcacggcctgctccgccgcatcaagcgcgacaccggcgcggatttcgtcatcgtaaacggcgaaaatgcggccggcaacggcgttctcccgcgtcaggcggatgatatttttgccgccggcgcggacgtgatcacgctcggcaaccatgtgttcggcaagcagcagatcgtgccgtatctggacagccgttcggatgttctccgtccggccaatcttgcgccgcaaagccccggccggggctggggcatttatgacggcccgcagggcatgcgcctgctcgtcatgaacctgatcggccgctgcgacatgaaatacggcccggataatccgttcctgtgtgcagaccgcatcctcaaggaaaacgagggcatgtacgacgtggctcttgccgaaatccacgcgaacgccacgagcgaaaagctggctatgggctattacctcgatggccgcgcggcggctgtctggggcacgcacacgcatgtgcagaccgcggatgagcgcgtcaatcccaagggcaccggttatatcacggatatcggcatgaccggcccgatcgtgtccgtgctcggcgtgcgcgtggagcagtctatcgccatgtttcgcggtgacctgaccgagtatttcaagacagctgagggcgactgtgcagtttctggtgcgctgttcgatattacaagaaacggaaaatgcaattccgtcacccgcgtgtgggagcgttggaatgtgagataaagtgtacgcagatgcacagtatcgcacttttgatacacgattgcgcattgtgaaacggattttgccatgcggaaacgtttttacaaaaagttctatcggcggacaagtgaccgtgtcaggaaaacagtgagaaatccctcaggttttgtacattttgcaagaacttgcaattcaacttgcaaaaaaagcaaaatcacagttgacgagagggtggtttttgcggtatgctataatcgaaagacaatggggcaaaggttaatggatttaaccggcccgtttagcataccgtggcgagggactccgcggtgcttaaggaggaaatgatacagatgaactcattgctcaccaaattcacctttaccgatgaattgaccgatgtcatcgagaactgcaagggcgtagttgttcccaccagcaaggcggaactgtacgacatggtattcggtccggaacatgccgacgtgtacgacgttgtattcgatgtaccgggcaagggtctggtaaaagaagctgatgttgtccgctgcaagaacggtgcatccgttaactttgtagaggattatatgcgccgccgcgagccggactgcatgcgcatcgcagatgacaagccgaccgacaagaagcgttttgcggatgtgtacggctacaagttcgacaagctgcgccgcgagaccatggactggttcaagacgcaggagctgatcctcatgccgtttaattccggcggcaaccagtacggctacggctccatgctcgtatgcccgaagcagtgcgcattcttcgcatttgcgctggcacatctgcagggctttgtaagcgcagaggagaccgagggctacaagccgcgtgcgatcatctatgttgcacctccgttccgtcacacccacttcgacggcaagcaggtcgttgttcacaaccgtctggatgactgccacgaggtattctcctataacctgtatccgggcccgtctgccaagaagggtgtttactccgtactgctcgacattggcgagcaggagggctggaccacctgccatacttccgcaggccgtctgatcaccccgtacgagaacgagcttgtcatcatgcacgagggcgcttccggcggcggcaagagcgagatgctgcaggacatcgcccgcgagccggacggcgaggtgctgctctctaccaacacggtgacgggcgaaaagacctacctgcatatcagctccacctgcaagattgagccggtgtgcgacgatatggctacctgctatccgggcgtgcagaacaactccggcaagctggtactcgttgacggtgaggacggctggttcctccgcatggacggcgtaacccactacggctgcgatccggtttacgagcgcatctgcaccgagccgaaggagccgctgtgcttcttcaacatggaaggccatccgggtgcaaccctgctgatctgggagcacacgctggattccaacggcaagccgtgctccaacccgcgtgccatcgtaccgcgctgggatgttccgaacatcgtcaaggagccggtagaagtagacgtacgctctttcggcgttcgtatgcccccctccacccgcgataacccgaactacggcatcatgggtatgctgcatatcattccgccggcactggcttggctgtggcgtctgatcgcaccgcgcggcttcaataacccgtctatcgtaaccggcaacgagctgaagagcgagggcgttggttcctactggccgtttgcaaccggcaagcgcgtaaagcaggccaacctgctgctgcaccagatcgtggacagcccgaacacccgctacgtcctgatcccgaaccagcacatcggcgtttacaaggtcggctttgcggctgagtggatctcccgtgagtatctggcacgccacggcggcgcaaagatccgccgcgagcaccttgagccggcacgctgcccgctgctcggctacgcgatgaaggatctgaccatcgacggccagaagatccgctctaagttcctgcgcgttgatacgcaggaccgcgtaggcaccgacggctacgatgcaggtgcaaagatcctgaccgacttcttccgcaaggagctggtgaagttcgatacgccggagcttgagccgctcggcaagcagatcatcgactgcttcatgaacggcggcacgctggaggacttcgagaagatcactccgaccggcctctaataaaatgtaaaagaaaatcaccgaaacaaatcgtttcggtgatttttttgttttcggcacggaatagacggggaacgtgaaccgcgtaaattttaccgtagaatagttagcgactctcgatttgccgaacggtcagcaagtcaccttccacggtgaatttgacctcaaatcccgcaaacgggaacccgtacacgcggcctgcctcgtgctgatagcccggtctcgggtcctgtgcgagtacgttcagcagcgtctgacggcgctcctcgggcagcttgtcgagcagagccgccggacattccacgcgcactgcatcggtcgtgagcgcaaaaccgccgcgtgcctccggatgcgaatccgtgtacgcaaggtacggcttgatgtcgaaaatcggcgtgccgtccatcagatccgcgcccgagatatgcagcaccgggccgtccggcgtgttctgctccacgcggtcaagccgcaccgaggacagtccgatctcgttcggccggaacggcgagcgtgtcgcaaacacgccgatgcgcttgttgccgcccagcttgggcgggcgcacggtcggggaccagccgtcgcgcacggctgccgaaaactgccagatcagccacaggtgcgagaagccctctatgccgcgcagcgcatctgcgttgcggtattccggctcgaatacgatgcgcgccggtacgtccgccagcccgctctgacgcggaatgccgaatttggtggggaaatcgctgcgtatccgcgcaataatgtgcatttctaccgtctgtgacataagaattctcctttggggtgatatattcagtatagcacaggaaatgtcgggtgcaaagcggtgttttacagattgttaatgttagatactgttgtaactgtgctggctggttggaaaactgcgtattgcgtgcgaaatcatctatgttatgaatagaaaaagttgtgttttgattttggctgacaccaatttgacaccatttgcgctgaaaagcctcagaaatgacaccaatcaattcgacataagggaaaatcagttttgagaggatgttgaaattgattgacgaaggctgtaagatattgtacaatatttacaaagaggtaaaggagtaaaagattatgaaaaactcgaaacgctggatcagcggagcaatggcggcatttctgatgttatgcgcaggctgcggacaaaattcgaacggtgcggattctgctgcggcagagacggaacaggaacagcagcaggagcctgtggtagaacaggttgaagatgtggatatgaccttatccttttcggtatatgaaggtgatgccacgaccaaagaaacatatgaaaaagagggtaaatatactggacagcttgtagatggtgtaccggatggagaaggaaagttcacaacggagaattcttctggtatagaatggtattatgaaggaacttttacacaaggcgcagttactggtaatggcgtgaagtgctggcccagtggtaatcagaaacacgtgggtcattttgttaatggtgaattagatggtaataaagcagatcgactgtataattgtgttcggcaatttacattaaaccttgagtacagtgatccggtagaaattccagatactgctatggccgtgattaagtccaacgaagatatttttccggctgtagataatgcagccaaggaaaaagctaaggcaatgattgatagctctattgaatataagcatttagttaagaacattgctccatatgtagataagatggtttattttaagaaccaaaccgtgcttcaagtattctgtgatacaatgtggggtaaaccatttacttatattctcactgcggatagtaattatgataattatcatgttgtgatgtatgatggagatatagatgtctttgaagatgacaatatcacctttgttgcactgccggtggccacttcgaattttgataacatcggcggcggtataacgaatgtagtggttgatgtggcatctatcatcattaagaactgaggataaaactatgaaacggacaatattgcttgctgcggcgattaccggtgttgttttcctgagtggctgcacggataccagtgctaaagatgcaacggaagcagtaaaaagtgcgtatacacaagcaatccaggaatcggaagtagcaaacgaaggtaaatctctgggagaatttatcgaccaggctcatggatacaatgaattgtatctcaaactaaccacactggataagaatttaagcgaaggctcggatgcggattacagcgatcaatacgaaacatattttggaagcaaaccgacatcagctgaggaagcaaaacagtggacagatgatgctctgggctatattgtggaagaagaccgcgatctgttatctccgttcattcgcacgatgaaggattccaccagtgtttctgaaggaaattttgaagaccagaaggcatctttcaaggtggaagatacagcggcattgctgaatgaactgcatttgtcagcggattcgtttggtaagattctggccatgacagatatttacgcatcgaagattgatttttctgaaaccggatttgacttttcgtgggatggcacaggtggagaatttacgctgaaattagttccgccagcagactgctatgtggattttgtggaaaagtttaatgagggtctgaagatatttgatccggaaggagcgggttctgattcggaagtgcgccatacaacattccttgatattgatgaggctgtggtcaatgatgtggatggtgcaccgacgtataatccggatttgaatcgagatggaaattaccgagaatactttgagtatgtcatgaatgatgaacaaacggattggaaacgcataactatttgctgctatataggttatgctttaagccagaaagatgcaatgagttatctgggcggagctgtaaactttacagattatgaaaaaactttaatgtatgcaacacaagagaatgctactgaagatgaaataactgatctttataatgcaatagtcaaagagggaaaagataaatatataataacaaaaaacgtcaacgggattcagtacacattcaaaagtgaagatggcccggcattgtacttcacagcagaaaagtgaaaataacaggagaagcaccctaatagggtgcttctctttatataagcgggtgtactgagggagaagatgagaacatacttgacgttctcacggtgagatttgccgagcaggaaccgattaccctgactgttatcctgtataacgatgatttttgattaaaaaataactgcggctgatgtgcgatttttcacgcatatcagccgctttttgatgtttatataatgattttagttgagaattgtaaataatacacgataaacgagaatgaaatttgtgcacaacgctgcgacccaaaatccggtttttcgtatagtagtatatgtcaagcaaaaaacactgcgcgacaagctgcataagcctgcgagaacgcgccacgatggttcctgccctaactgcgcgtatctcttgacggacgaccaccagaaacgattctgcgccatcttgcgcccatttgtagaaagaggtgaaatcccatgatttagcaagccagccgcacggccactcaacgacatttcagcgttgagttcagccagcgattcacaattcaataacgtttcggtatcgagttcagccagtgaccactcacgaccaacgaccgcgaaggggatgactatgatttgacaaacagcgcagaaacgctataagcctgcgagaatgcaccacaatcgttcctgccataccgtttcggtaccgagttcagccagtgaccaaccacgatcaatgaccggaaagagagtgattacaatttgatagacagtgtgaaaacaccataatcctgcgagaatgctctgtaatcgctttttgatgcctctggtgcaccattcgacgaacaaccaccagaaacgattctgggcgattctgagtcgattatgaaaggagtgagaaattgtgattaaactattcaaaataagactaccatcaagtgcgggagaagtcaagtattttggctcattcccacgttcgagtttgattcgtgcaatcgagaaaattcaagaaaacttaaattttctgtctgggcggacttttcccgaaacttcggtgagccgtgaaagctgttttccgaaaaatcggggcgagccagacgaaaggatagaatgttaaaattcaaaaaacgcaaaggagaaaattaaaatgatgaatgaagaacagtacattgcaatgatgagagaggatatgaaagaaaatttcacaatgtcttttcgtaaccgaccgtcgcagatcagcgtcccacgggcgctgttcgacaaccctaaatacgcgcaactgtcaacaggtgcaaaatgtctgtatattttgatgttagacaggctgtttttgctttccactgatggatggttcaatgagtcggaaacgccgtatgtctattacaagatgaaacagattgcggctgaccttcattgtgcacgcaacaaggctattaagctggttactcagcttgaagatgcgggcttgattacacgagtaaaggcagagcattaccatccaaatcggtattacattcacaacatcacggaggataaaaatgagtaattccattaccacaccgaacgaaacgttcggccagagcgaaagcacacaagcgttcgccaaactgccgaaagttttctttgatgaaaaagcgccgcaatacccacaatacaaacacctgacagcacaacacattctggcgtacaccctgatgcgtgaccggctgcaactgtctatcactaaacagatgaaagatgagaatggcacgccgttcatctattatgaccttgaaaacatagcgtcggctgttcgctgtcgcgcaaagaaagctgggaaactggtagacgaactggacaaggcaggattgattcacaaggttcggcagggattgggaaaacccaatttaatctatgtgtatgatgtactgcaagctagcccgtcaaatagacagttccagaccagtccggcagacagtccagacccgtccaacggacagttcaagacccgtccaacggacagttcaagatcagtcgaacggacagttcaagacccgtccaacggacagagtaataagactgataagaataatactgaaattagtaagactgataacagtaacactgatagtaacgatactgaaattagtaagactgataacagtaattactctgtcaatggtaacaagcgggctttggatggcggttttatgaccttggatgcaaaaaattattttctggccagaaatgaagaatctttagtggatgaagtacgtcagttgctgtttaagatagtgaaggcaacaccccaaactattcgtattgatgatcgagaaatgaaaggtaatgcagttagtaagcaattagagaatatcagcatagcacaaatcgaaactgcactgaatcacgttatagagaaaaaatgttcagaggaacaacgggaggagtgcttaacggcagaattataccatgtcacacaagaatccagccaacaaagcaataccactgcgctggctgaaataagtgaagaaacgcaagttcagaatagaaagaatttcgaccagacaagcgaggaatctgatgatttatggaattaagcgttttgggcactggttgaactaaggatgtgtcacaacttgctatcctcttactggctggactaagggagtaacgagcgggtacacccttgttgattataaccgatgaagtcgcggaacacgcccccgtgttaaaggtatcaccgaaatgatgacaccttgattaagggagtcgcaagacacgacacccttacggactgtggctgatagagtaacgaaacgttaccctatgcaaaggagtgaccgaaacgttcaccccaacggctaaaggcgggaactgcgacctttgaacaacagcgcaccagctgcaatactgtcgcgtttcacgacggtattctggaagatacaaggcatttgagagtaaagagagagtaagcagctatttactgcgctgcagatttcgttttaaggagaatcccgctcgatgacgggtatgatttacactttttacgaccactgcctgcacatgagcggatgagtagctgcatctcaatcaacaaataagaaaagaggttttctatggcaaataaaaataagaacaatattaccccaatctgggaaagccctttattaaatgtagaggaagcatcggactattttcacattggtgtcaacaagattcgagatttaactaatggagataacaatccctatgtgctgtggattggtacgaaacgcatgatcaagcgcgcgaagctagaacaatacctgttgggaagctattcggcgtaaaaacagtgcatttctgccccaactatgatatactgaatatgtcatatttggggcttttcagtcaatgaaaggagagaaaaacttggctggaaagcgaaaagataaaaagggacgaattttactgaaaaatgagagcgaacgctcggacgggcgttatcagtaccgctataccgatgttttcggcaaacggcagacgttctatgcgccgactctggatgaacttcgtcaaaaagagaaagaactgcagcgtgcattggataatggaatcagctattctggcggaaagatgacaattaatgaactggttgaaaagtaccttgctttgaaaagcagaaaatgctacagcacagtgacaacatatcaatcatgggcggacagcattaagcaggaaccctttagccagcggtctatctgtgatgtaaccaagcaggatgcacagctgtggtttcagaagatgcaggaaacaggtagggcatacagtacactttctgcgtataaaaaactgctgaaacctgcattttcgatggcgattgacagtaaactgcttcttcaaaacccgtttgatttccgtatggacagcgtagcctccaatgatacagttaagcgcaatgcattgacagacgaagtaatcaccaccttgctggactttctgaagaacgacaagcagtatgcacgatattatgatgtgtgtgtggtattgctgtacactggaatgagagtcagtgagttttgtggattgacaacctcagacctggattttgagcagagaactatcagcatcaataaacagctgctccgcagaaacgatggaagtcgctacattcagagaatgaccaaaacaaaagcgggaatgcgtactctatttatgagcgatgcagtcagtgaaagcctgcacaatatgattcgcgagcgggagaaacaaaaggtatctccaatgattgaccagtgcggcggattcctgatgctgacccgacaagggaatcctgtggtagcctgcaatctggaagtgccgctgaaaaaggctgtgacgaagtataatgcagaacatccggaaaaactgctgccgcgcattacaccgcatatatttcggcacacgttttgcagtaatatgctcaatgatggcgtatcactgccgaatacacaggcaatgatggggcatgagaatccgaatacaacactgacgtatgcgcatccggatgcaacgcaggctatggctgagatggcgcgtatcaacagacagcgtgaacaggctcgcgcaagcgtttgaagatgacaccattctgacaccatttgcaggtgcagttgtgtgaagatgtggaaggttatggaatgcacgggattcgctgattcatgagtatgttgtgaaaaacgctaattccgtagggaaatgcacattttacgcatggaagaattcaaagaagaaatgcctgacttgttacagattgttaatgctttttcctcaaaaacgcgctataatagaatcagattaaactgggaaagcaggggagaactatgcccaagaagatattgatcgtagaggacgaggccaacatccgtgagctgctgcgcctgtatctggagcgcgaaggctacacggtgctcgaggcggaaaacggcgtggagggcatcaaaaagtggaagtcggacaagccggacatgctgctgctcgacgtgatgatgccggtgatggacggctgggcggtctgcagggagatccgcgcggagagcgatgtgccgatcatcatgctgacggccaaaggcgagaccgcagaccgcgtttccggtctggagatgggtgcggacgactacatcgtcaagccgctcgaaatgccggaggtcatcgcgcgcgtgcgtgcggtattccgccgcatggcgccggatgatgcgcccgagaagctgtcgtttgacaatctggtgatcgacaagcaggcgtacgatctggtcatcaagggtaagcgcgtggatgcaccgccgaaggagatcgagctgctgtacttcctcgcgtccagtccgaaccgcgtgttcacccgcgcacagctgctcgacgatgtctggggctttgactatttcggtgacacgagaacggttgatgtacacgtcaagcgtctgcgcgaaaagctggagggtgtttcggacaagtgggagctgaaaaccgtatggggtgtcggctacaagtttgagaccaaggagtaagccatgggcagacgcagttttttcttcaaggactatgtggcccatctggttttgatcgtgtgcgcgtttgcactggccggcgtggtgttctgctaccagatgagcagctacgcgctgcacgccaagcagaccgagctgcgcacgactgtgcagagccttgccgagcagagcaagctgctcgagggcacggactccgacgtgatccgtcagatttacatgctgtccatcgcgcgcgtggccaaggaggatgagctgaccgtgctcatcacggacgcggacggcaatattgaaatgggtgccaagccggacggcacgacctacacgctgcccggctatcatatctcagccgaagtggttgcggagatgcacaaaaacggcagttatgcgtctgtcgggtcgctcggcgtgctgagtgagtcctcgttttacacggtgggcacctgcgtcaaggatgataacggcgatgcggatttgatgatcttcgtctccactcaggacccgaattcggcaggcgtggtgcgccactccacgcagacgctcgtgctcatcatgttggtggcgctggtcgttatgctggtgatttcgttcataatctctcagcatgtcacgcgtccgctcaagacgattgccgccgccgccaaggaatttgcgggcggcaacttcgatgtgcgtgtgcccgaggataaccgctgctacgagattgatgagctggcggtctcgttcaacaacatggcgcgcgaccttgaccagctcgaggagctgacccgcggctttatttccaacgtcagccacgagttcaagaccccgatgacgaccatcggcggctttgtggacggcatgatcgacggcacgattccgctcgaccagcgcgacaagtatctgaagatcatcgcggaggagaccaaacgtctgtcccgcatggtaaatcgcatgctggatgccgcaaaaattcagtccggcgagctgatcctcagtccggcgccgttcgactttaccgaaatgacggcgcagatcctgctctcgttcgagcagaagattgagaaaaagaagctggatgtgcagtgcgacctcgaggaacggctgactgtcatgggtgaccgcgaccacctgtaccgagtggtgtacaacctgaccgataacgcggtaaagttcatcgaggacggcggtacgctgaggctgaaggtccatcaggagggacagctgtgtgtattcgccatcagcaacaccggcatcggcatttcggcggaggatctgccgcatgtgttcgaccgcttctacaagaccgaccgttcgcgctcgatggataagaccggcgcgggtctcggcctgtatattgtgaagaacatcatcaacctgcacggcggcgagatctccgtccgctcgggcggcggcgaaaccgagtttgagttcaccctgccgctcgcaccggagcagaaccgacagaataacgcgtaaaaagtggcttccatgtgctatcactgtgcatggaagtcttttttctgcatgtgctgtattgaagcgtttcgcacggcagtgcgcatgaaatagcatttgctctgcaaatgctcaaaaagggggagcatgtatcaccctttttggacttctggagggagaaagtttctgaacaggaactttcggacgactttggaacggcccacggtccgttcctcttgtcggcgaaactgtagtttcgcgacaggcagtgttcaaaaaatattcatattgttttcaacaaactgccacattgagaaactatgatagaagcatcaacagagggaacggaatgttcccgcgaataacaacaggaggtcagtatcatggacgacttcaacatgaacaacaaaacaccgctgaacagcagcgatcagaataacgaacagccggccgccgaaacccggaacaccgtaccgcagaacgagcagcctgcacaggcaccgcagagcgagcagccgatgcagcagccgcaggcggaacagcccgcacaggcaccgcagagcgagcagccgatgcagcagccgcaggcagaacagcctgcacaggcaccgcagaacgagcagccgcaggcagaagagccgcgcacaccgttccagacgccggtgcagcatccggagttccgtcaggcgcagcagcagaccggcttcggcgaggttccgccgatgagccagaagccgcacaccccgaagaataaaaagcacagcagaggcttagcgctcggtctgtgcggcgtagcagccgcgtgcctgctgtttgcaggcggcgcagttgtcggcaatatggcgttcggcggcaatgcaaacagcgattcgggcacttcggcatcaacttcggattccgcgccgacgctgcagatcaacagcaagccggagtctgattcgagcaattcctcggacaactacgacaccgcggacggcatggccggtgaggatatctacaaaaaggtcaatccgtcggtcgtatcggttatctccaccaccgctgagggcacgggcagcggctcgggcgtcatcatgagcaaggacggctacatcatcaccaacaaccacgttgtggacggcgcgcagtcggtttccgtacagctgagcgacggcacctctcttgatgccgagatcatcggcacggatgagcagaccgatcttgcggtcatcaaggtaacgccgacaagcgacctgaccgccgcagagttcggtgactcggatgagctggagccgggcgagtatgcctacgcgatcggttctcccggcggcgtacagtttgcgaacaccatcaccggcggtcgtatttccgccatcaaccgcgatctgaccgtcaatgaccgtgttatgacgctgattcagaccgatgcttccatcaacaacggtaactccggcggcgcactgatcaataagtacggtcaggtagtcggcatcacgtccgctaagctgtccggcaatgcgttcggcagcgccaccgttgagggtatgggctttgccatcccgatcaacaccgccaaggatattgttgatgaactgattcagaacggttacgtttccggccggccgtccatcggcatcaccggccagaacgtcgagtccgcggacggcaaggtgtccggcgtgcaggtatattccattgattcccgcgcaaaggcagccagtgagggtctgcaggtcggtgatgtcatcaccgccgttgacggtaccccgaccccggacatggataaggtaaacgaactcaagcaggataagaaggccggcgacaagctgacgctgagcgtataccgcatttcgaccggcaagacgctcaatatcaccatcacgctgaccgattcgcacgacctcgagggtgatgacccgaatgcccagacccagcagagccagagcagccagaacgataattcgcagcagaatgacggctacggcagctatggattctccagtccgtttggttcgttcggctggtaattttaatagagtgaagagtggagagttgagagtgaagagttcgtaacgatttcacttttcgctcttctgttaagcaaaaagcagactttcaatcgaaagtctgctttttattatgggcatcatgtgaatctggagcgctatctctccactcctcactcttcactctccactcttaattggagtactgctccgccagctgctggctgataaactgtcttgcggtacgcggcgaacgtccgttacggcgcagcgcgaagcgctctgcaagcaggtgcagctcgtcgatatcaaggttcaggtcgttctccttggccagctgctcgacgatgtacagatactcgtccttatccggcacggagaaggtgatctccagaccgaaacggtcggacagcgaggtaacggtctcgagggtatcgcgcacgcgcacctcatcgccctgacggtcggccatgctctcgcggatgagatgacggcggttggacgttgcgtaaatgaccagattggacggctttccggccagaccgccctcgatgaacgccttgagcgcggcaaagttgtcatcctcgctgctgaaggtcaggtcatcgaggaatacgatgaaacggaacggcgaacggagtgtctgctcaaacagcttggggaaattcgtgatctgccgcggagacatctcgatgatcttcaggccgcggtcggcgtactcgttggcaaccgccttgacggtcgaggacttgccggtgcccttgtcgccgtagagcaggatgttgttggcgtcgcgtccgtcgaggaaggcaagcgtgtttttgaggattttctgcttctgcatctcgtagccgggcaggtcgtgcagacggatggcatcgggatgcacgatcggggtcgccgagccgtcgtcctgcatggcaaacgccgaggactgtgcgaagaagccgtagccctcctcacgatagtaatcggcaagcgctgcgccggtggagaacggaagcgagtccgcggcctcgaagtccggcagatcctcgagggcaggctcgtagaacttgtccgctgcggcggacttgaaggcttcaccgtcgagcgcgagcagagcgttcagcacgtccagatcgtgggttgcggcgttgagcacagccgcttccggtgcgttgatggtatcagtcagggtgttggtgtcaaagtgcacggcgtcgagcactgcctgcgcgatatcgccgcaggagaagcgtgtcgcgcacagtgcgccgtagcggtcggcaaagtcggcggctgtgccgtcgagcgcggtcagcgtgtcgccgtaggcgcgcaccagcggatgggaaagcagtccgcgcagcacggaaagcgcgcgcagacgcagggaaagggcggaaagctccattgttttcaactccagtcaggattgtagtttataacctaatcagcatagcacacttttccgctcatttcaacatagtatgaggggagaaaccttaggacaacaccgcgcaattaaagctgcggctccttgcgcaggctccggtcgcgctgccgcggctccttgcgcaggctccggtcgcactgccgcggctccttgtgcaggctccggtcgcactgccgcggcgctttgcggaaattttgtgccctgactttggcttcggttccttgcgcgagttccgtccgcgctgccgaaatttcacggtaatacatcaagtattaccgcaaaactgcgcctcgtcagttcgcaaaatttactcacaaatcgctcttgttcaattatgcggtattgccttagtttctcagaattgggagggaggagtgcccttatgggcggttatgcgctgttgatctgccgcagtcagaccgaggccatcggcctgcggcggcatttggcgcggttgggtgtaccgggagaggtcgcgcgcccgccgcgtcacgaacgaaccgaatcctgcggatgggcggtgcgcgtgagcgcgcagcaggcggactgggctgtgcatcggctgcggcagcttggtgcgccgccgtgccgcgtgctgcgggaggactgacatgatctatctggataatgctgccaccaccttgtataagccgcgggcggtcgagcaggcggttcgccgtgcgatgtacggcgcggcaggctacgcacgaggcggctatgcggcagccagtcgagcgggagagctggtgtacgcctgccgggagcaggcagcggcgctgttcggcgtgggcgagccggagcgagtcattttcacgctgaatgccacgcatgcgctgaatattgcgataaatgcgctcgtaaaaccggattcccgcgtcattgtgagcggttacgagcacaatgcggtcatgcggccgctgacggctcgaaatatcgagccgaccgtgctggatacgccgctgtgggacggcgcagctatggtttctgcgctgagacaggcgctggaacacggtgccgacctgatgatactcagccacgtttccaacgtgttcggcagcattgcgccgctggacgaaatcgcggaattgctgacggcggcaggtgtgccgctcatcctggatgcgtcgcagtcggcgggcgtggcggagattgacgtaaagcgctatccgtgtcttgcggcggtgtgcatgcccggacacaaggcgctgtacggaccgatgggcacgggcattctgctggcgctcgacgaccggattgccgcgaagccgctgatgaccggaggaacgggcagtctgtccgaggagctgcgccagccggattttctgccggatgcgctcgagagcggcacgccgaacgtgcccggcatcgcgggtctcgcggcgggcatcgcctttgtccgtgcggtcacgccggcgcacattgccgggcaggagagacggctggtgcatgagcttgcccgtgcgctctcccgcgaaagcaaaatcgagtgctttgccggaaaggagcagaccggcgtgctgtccttccgcgttcccggcacgccgagtgaggtgctcgcggatatgctctcggacgagggggtgtgcacccgggcggggctgcactgtgcgccgctcgcgcaccggacggcgggcacggaggacaccggaaccgtgcggctgtccctgtcgttctactcgacggcgcggcagctggagcaggctgcagacaaagtttgcagattggtaaaaaaactgtgaacacgctatacagaaagccggatttgtggtagtataagtaaggtaaaacatggctttctataaaggtaacagactgcggcttgtcgaaaagaagtctgtgctttaccgatttgctttttttcgcgcgtcagcgcgcataaaatagaatttgctcagcaaattcataaaaaacgggagcatgtatctcgttttttatacattaagagggagaaagtttccaaatgggaactttcggacgactttggaacggcccacggtccgttcctgttgtcggccaaaccgtggtttggcgacagccaaaaaatgaggaacaagttaggataggtgacaaaatgggagcgctgcaaaatgtattctcaccgaatttatcatggcggaccatgataagttcttttttcagtgcgtttgatcaattccgcacaatgacgccgatcgacgtggtggatatcctcgtcgtggcgtatatcatttaccgtgttatgaagctgctgaaggataccagcgccgcacgactggccaagggtattcttattctggtgcttatcatgctgttcgccagcttcctgcatctgaccatgatctcgtggctgctgcgcaacgcgctcagcgtcggcgtattcgccgttgtggtcatttttcagccggagctgcgccgtctgctcgagcagatcggcaagggcaacctcagccgcatgctgattccggataccgacccggatgtggtagagagcatgatcgttgcaaccgtttccgcatgcgcggatatgtccaggaccaagaccggcgcgctcatcgtgttcgagcgcaaggagcgtctcggtgagatcatcgccaccggcacgagagtggacgcggcaccgtctgccgagctgatcaagaacattttcttcaagaacagcccgctgcatgacggcgccatgatcgttcgtgccggacgggtgtgcgctgcaggctgcgtgctgccgctttccggcaatcagggtctgtcgcgcgacctcggcacgcgccaccgcgcggctgtcggcatgagcgagaccgcggacagcgtgctcgttgtcgtctccgaggagaccggcgcgatctctgtcgccatcggcggcatgctcaagcgccatctgtcgcccgagattctgcagaagatgctcgagagcgagctgctcggcgatgaactcaggagcaaaaacgataaaagccgtattgccgccatccgcgacaagtggaagggaggcgccggcaagtgaagaagaattttctgaaaaagcaggattttctgctgaagatcctgtcgctggcgctgtctatcgttctgtgggcagttgttatggatgttgacaatccggagcgcaatatgcgctttgacgatgtgccggtgcgtatcatcggtgcatcccagctgaaagcagcgaccggtctggaactcatcgagggcgaggacacaacggtcaccgtcagcctgcgcggtcagagcaagagcgtcggcgaggtccgcgtcagccagatcaccgcaacagtggatatctcgggtctgaccgaggcgaatgaatacgatcttccggtcaccgtgtcggtcagcaagtccggcgtggagaccaactatgtcaatcccggcaaggtgcacgtccgcgtggaccgcgtggagagcaaggatgttccggtcgaggtcaatgtgaccggcacaccggacgacggctaccgcgcaggcaagccgaccacggcaaccaagaaggtcaccgtttccggtccggcaaccgatctggcacaggtgtccaaggcggttgcaaccgtggatgttaccggccgcaattcctcgctggccgactacgaatgcagggtaaccctgtatgatcaggacggtgcggcgttcacctcgaactatatcaccagccagaccgaaaagatcaaggtttcggttccaatctaccgcgtcaacaacattccgctgaccgtcaccctcaaggacggcggcagcctgacgcagaatcaggtacagtgcgtcatcgacccggagaacgtagaggttatcgcgagcaatcaggcggtgctgagcgacatcaaggagatcaacctcggtgagatcgacctcggcagcgtccacacgggcacgccgatctccatgtccatcaaggataagctgccgagcggcgtttcgctcgtcagcggtcagccggaaacggcaaacgtcaccatctcggtggacggtgttgcgacccgcaaggttcaggtctccaagttcgcgtggaacgacaccgcgcaggagaatacgccgtacacggtcaacatcctcaccaagtcggtcgagatggagctgcgcggcagtgaaagccagctgaagaaggtcgatgtgaataacctgtccatcggtctgacctacgattcggtatcgctcggcgtcggcaggcacacggtcaagggcgtggctacgaccgtcggtctgccgagcggcgtaacgctcgtcgaggaggatatcgaggtcgagattgagatcaccgacgcgcatgtgtcggatgagacgatcacctcggataagacagacagcacagacgatacggacagcacggtcgcagagccgaccgcgcaccgtacaaggaagggcggtggcagccagtgagcctgatggtaaccggcatccgtctgccgtttgatctgccggagcaggccgccattgcggaggcacgccggctgaccggtctgacggcaaacgacatacaagcggcggtctgccgcgtcagcattgacgcgcggcgcggacagatcagccgggtatattcggtgcgtctggacgcgccgttcgacgaaaaggcatttgcagaaaaactgcaaatgcccttcgtgcgttataaacccaatacgaaaatcgtcattccgcacggcgaaaagcggctcgagcaccgtccggtggtggtcggtctcggtcctgcgggactgttcgccgcctatgtgctggcaaagcacggctaccgtccgctcgtgctcgagcgcggcggagatctggacgagcgcgacaaggttgtggatgcgttctggaagggcggtgcgctcgataccgactgcaatatccagttcggtgagggcggcgccggcgcctactcggacggcaagctgaccacgcgcatcggtgatccgctgtgcgacaacgtgctggaaatccttgccgcgcacggtgctccggcggatatcgtcaaaaaggcgaagccgcacgtcggcacggatatcctcaagaatgtagttcgtgaaatgcgccgcgagatcatcaaaaacggcggtgaagtgcggttccgcacggcgctgaccggcatttcgatgaaaaacggtgcgctctgcgccgtgcaggcggacgggcaggacatcgcctgcgagcgggcggtgctggccatcggtcactcggcgcgcgacacgttcgcggcgctgcatgagaacggcgtgtacttcgagcccaaggcgttctcggtcggcgtgcgtatcgagcatttgcaaagcgagctcgaccgcgctctgtacggaaaggcggcgggccatcctgcgctgccgcctgcggagtacaatctctcgcgcagagccgacggacgcgcgtgctattccttttgcatgtgcccgggcggcgtggtcgttgcggcacagagcgaggagaacacggtcgttaccaacggcatgagctatcatgcgcgcgacggcaaaaacgccaacgcggcgcttgccgtgtcggttgatccgaaggactacgacgacggcacgccgttcggcggcgtggcgctgcagcgctggatcgagcacgcggcgtacacgcagaccggctcgtaccgcgcgccgtgccagaaggtcggggattttctgaacggcaagccgacccgaaaactcggtgcggtcaagcccagctatcccatcggcgtggagctgggagaggcggcagcctgcctgcccgacttcgcgcagaccatgctgcgggacagcctgccgtatttcggccggaagattcgcggctacgacacagcggacgcgctgctgaccggtccggaaacgcggacctcgtctccggtgcgcatgacgcgcggcgaggacctgttcggactcggctgcagcggcatcattccgtgcggcgaaggcgccggatacgccggaggcatcatgtccgccgccgtggacggtatccgggcagcgttccggattatggaagagtttctgccagagtgaagagtgaggagtggagagtgaagagatcgtttggatttggcgtttcgccatagaagcaaacgaatctcaactcttcactctcaactctccactctactgcatatagttagcgattatagagaggaaagataaaagtgactcaacagggaaccatcaaaaagctgctgccgaacggtctggcagaggtcgaggtaacgcgccgctcggcgtgcggccatgactgtgccaagtgcggcggctgcggcggtctggaaacccagacgctttacgttaccgcacgcaatcacgcgcatgcgtccgtcggcgaccgcgtgctgctcgaaggcgagacgaagcaggtgctcggctttgccgtgctcgtgtatctgctgccgctcgtgctgttttttgtcggctacggcgtcggtgcaggaatgaaacttggcggcggactgtccgcgctcatcggcggcgcgctgttcgtcgtcggcattctgacggccatgtggtacagccataagctgaagctcagaaacgaagcgccgtttgccattaccgagcggctctaagaaatagagtctggaatagagtgaaggagtttcgcgacaggcagttttaattttttatgaattttcgccaattttccgcgttcgcccttgtcagatacgcaaaagttcggtaaaatagattgaatacgaaagtccgtgcacaccgcacggcgggaaagggctatgcgatgtttggctttatccgtccggtgaaggccgagctgcgagtgaaggaggctgaccgttttcagcaggtttactgcggcttatgccacgcaatccgcgcagaatacggcagattttacaccttgtttttaagctacgatatgacgttttttgcacttgttgcaggaagtgaggaggcggagactgctccgccgtgcagaaaacgatgcgatgcttctccgtttcggcggaaaagctgcgccgagacagacgatgcacttcgtctggcggcggacgcgagcatcctgctgacctatcacaagtttcaggatgacctggcggacgaaaagggcgcgaaacgcgcgcttgcggcgctgctgtgccgcctcggccgccgcggctatgagaaggcgcgcgcacgcatgcccgaagcggatgaggacatccggcaggcgctcgaggatctgcgccgtctggaggcggaacgctgcccgtccatggaccgtgcggcggatacgtcctcgcgcatgacggctgccgttgtgccgcacaccggagacacccgcgagcgtattctgcaccagatgttctaccagatcggcaggtggatctaccttgtcgatgcggtgcaggacatccaaaaggatatggaagagaacagctacaatccggtcgttctgcggtacgagctgcaaacgccggacatctctgcggtaagggaaccgctcgagcgcacgctcgaacgctcactggcggatatctgcatggcgtttgacctgctgagtccccggagagatgcggacctgatccgcaatatcatttttcttggtatgccgaccgtcacccgacaggtactgaacggcacctaccagacgaacgaaggaaggggcaaacatggatccctataaagtgctcggtgtaacaccgcaaacaagtgatgatgacgtcaagcgcgcgtaccgtgagctggcgcgcaagtatcatccggataactatgtaaacaatccgctggcagatttggccgaaacccgcatgaaggagatcaacgaagcgtacgacatgatcatgaacgaacgcaggaatccggcgggaggcagcagcggtcagcagcagagctatggcggcgcatacaacggtcagcagtacggcggctatcagcagcgcacctacaccggtgcgaatgccgcgctgtacagtcaggtgcggcaggccatcaatcagggcaacctcggcatggcggaggcgctgctgcagcgtgctgcaggacgggatgcggagtggttctatctgaccggcacggtatactaccgcaagggctggtacgatgaggccgcccgcgcgtacacgcaggcgtgtcagatggacccgaacaacgcggagtaccagcacgcgctgcagaacctccatctgtccggcggctacggcggctaccggcccatgcaggagacaagcatgtgcgactgctgtgtgcagacgctcatctgcaactgctgcctgaacatgtgctgcggaggaggcggctgctgatatgagcacgcgcgagatcgcccgcggcggacttctggcagcggcggccacggcgtggctgtatttcggcggtgtgatgccgcagatcggaccggcggcctgcctgatagcaggtgcggcctcagcgataccgctgctgcgccgcgcgaacataaaaacggctgggctgctgtacctcgtcacctcggtactgggactgctgctgacaccgcgcaagctgatcgcggcggcctatgtgctgctgttcggcctgtacccgatcgtgaaatatctgatcgagtgccgtctgccggtcttcacgcagctgagcggcaagctggcgtattttaacattgtgctggtgctcgcggccgttctggtaagctgcggtctgtttccgcaggtgcagatgccgggtattttccggcttgccggactgtggatcgcggcaaatatcggctttattgtatatgatatcgggttgtcaaaggtgatcgcgctgctgcgccgcaccctgccgcccgaataagaagggaaagagatatctatgaagagtatgaccggctacggacgtgccaagcaggagctgcacggcagaaccatcacagcagagctgcgtgcggtcaaccaccgctatctggactgcacggtaaaggctccgcgtcagtacggctttctggatgatgccgtgaaaaaggctgccgcggcgcgcattgcacgcggcaaggttgaggtttacatcggcgtggagacgcaggagggcggcgacattgcggttacggtgaaccatgcggtcgcggagcactatctggcggcgctgcatgagctggctgacaagtacggtctgcgcgatgacgtgagcgtgatgagtctggcgaagctgccggacgtgctcggctccgagcgcatcgagcaggacgcggacgagatgacccgcgatgtgctgtccgtctttggcgaagcctgcgacaatttcgacgaaatgcgtacccgcgagggtgcaaagctggctgaggatgtgcgaaaccgtgcgtccgagatcgagcgcatggtcggtgaggtggaggtccgctcgccggagcgcgtgcgcgagtaccgcgagaagctgctcgcccgcatgaaggaggtgctggcggatacgtccatcgacgagacccgcatcgtcaccgaggcggccatctacgcggacaagaccgccgtggacgaggagaccgtgcgtctgcgcagccatctgcagcagctggacggcatgctgaatgaggtcaagccggtcggccgcaagctggatttccttgtgcaggaaatgaaccgcgagaccaataccatcggctccaaggcaaacgatgtgtccatggcgcagatcgtggtcaatatcaagagcgaaattgaaaaaatccgcgaacagattcagaatatcgagtaatttgcagtatatcgaggagtgaggtcagcgatgaagctcatcaatatcggatttggcaatatggtcgcttcgtcgcggctgatcgccattgtcagcccggaatccgcaccggtcaagcgcaccgtgcaggaggcccgcgaccgcggcatggtcgtggacggcacctacggcagacgcacccgcgctgtgctcatcatggacagcgaccatgtggtgctcagtgctctgcagccggagaccgttgcggctcgttttgcgggcgagaccgaggaaggagaaccagaagatgcgtaagggaacgttgtatgtattcaccggaccgtccggtgcaggcaagggcacagtgctgtccaggctgctgagcgaggacgagaagctgttcttctcaatctctgcgacgacccgtgcgccgcgtccgggcgaaaaggacggcgtacagtattatttcctcacgaaagaggactttgaggcgaagatcgccgccaatgcgttcctcgagcacgcgaagtacgttgataactactacggcacgctggaggctccggtgaacgaaaagctggaggccggctatgatgttatcctcgagatcgaggtgcagggcgcgatgcaggtgcatgaaaagcgtccggatgccgtgatggtgttcattgcgccgccgtcgttcgaggaactcgccaaccgtctgcgcggacgcggcaccgaggacgaagccaaggtgcagaagcgtctggaaacggcgaagggcgagcttgcccagcaggataaattcgattacgtcgtcgtaaacgacacggtggagcgtgcagtaaacgaactgcatgaaatccttaacaagcgtcgataaacgacattatataaacagaaactttcataaaataaaactatatctggtaaataaggagaactgattactatgctgaacccttctatgcaggaactgatgaaacgagtaggcaaccgctatctgctggtaaacctggcagcgcagcgtgcccgcgatattgccgatgaggcagaggaaaagggcgagccgctgccggacaaggctgttaagctggcgctcgatgagatcgcagccggcaagatcgtttaccgtccgggtccgcgtgtggagactgccattccgcagaacaatgccattgcagccgctatggttgacgtggacgacacccttgatctggatgaggacgaggagcacaccgactccgaggctgacgaggacaaggatgagaatgcggacgaggtgcgccgcctgaacgagtttgacgacggctctctgagcgacggtgacattccggaggaggacctctaagccatgcgttttgcagggaaaacggtcgttctgtgcgtgacgggcggcattgcggcttataaagctgccgatctcaccagcaagctgcaccagaacggcgcgactgtccatgtgctgatgaccgagtctgcgacccagtttatcgcgccgatgacgtttgaaacactgtccggcaaccgcgcggtcgtggatacgttcgaccgcagctttccgtgggaggtggagcacatttcgctcgcgaaggcggctgacgtgttcgttatcgcacccgcgaccgccaacgtcatcgccaaggcggcgcacggcatcgcggacgacatggtgacgaccacgctgcttgcaaccaaggcgccggtcgttgtcgctcccgcgatgaacaccggcatgtatgacaatccggtgacgcaggagaacctcgctgcgctgagaaagcgcggcttccacatcatcgagccggacgcaggccacctcgcctgcggcgacagcggacgcggcaagctgccggacacgcccacgctcctctggggcattgaaaaggcgctgaccgagcaggatctcagcggcaggcatatcctcgtcaccgccggcccgacacaggaggccatggacccggttcggttcctgtccaaccactccaccggcaaaatgggttacgcgatcgcggcccgcgcagccatgcgcggcgctgacgcaacgctcgtttccggaccgaccgcgctcgatacgccgcacggtgtcacgcgcgtggatattgtttccgcgcgggatatgtacgacgcggtgacaagccgtgcacccgagcaggatttcatcatcaaggctgccgccgtcggtgattaccgtccggcgcagactgcggatgaaaagctcaaaaagggtgacggcgagatgaatatcgagctgacccgcaatccggatatcctcgccgcgctcggcaaggacaaaaagccgggacagctgctgtgcggctttgcgatggagacgcagaaccttctcgataacgccgagagcaagctgcgccgcaagaactgcgatatgctcgtggcgaattcgctgcgtgataagggtgcaggcttcggcacggataccaatgtggctaccttgctgttcaaggacggacacagagagaccccgccgatgatgagcaaggaagcacttgctgacctgattcttgaccgactgctctctatgaaatgattagtagttagtaattaggaattagtaattttgcgaaggcagatgttttcgcaattatcgtagggtgcgacgacctcggcgcaccgtatctaacgattggcacaatcttcaccgtaggggcggtcattggccgcccacgcccatttaacgataatgtgggaggtcactgacctcccctacgggctacataatgccaatgaatttacatgcggtgcgccgagtcgtcgcaccctacagtataacgaaatccacatcgtaaaattgataagaaagatgagaaaggtcgtgaacccatggcggaaaaaatctgtgcagtcgctgtggatgcagcgacctacgccatcgacaagctatattcttaccgtgtgccggacgagctgcgggaacaggtgcagatcggcacccgtgttctcgtgccgttcggctttggcaataaacgggcggaagcggtggtgctcgccttccgcgaggatgcgggcgagttcaaactcaagcccatcgtggaggtgttggacgaaacgccgattctgaccgctgagcagctgagactcgcggcgtggatgcgggaaagattgtactgcacctacttcgactgcgtacacgccatgctgcccgccggattgtggttcaagagaaacgagacgtacacgctcgcgccggacgcggatctggcggctctgcgggagcgggacggcgaagccggtcaggtgctggcgttgtttgagcagccgggacagacgctctcggtgagcgagatacgcgaccggctcggcaaaggcgcgggacagacactggacgcgctggcaggtgagggaatcctcatctaccacagcaatacggcgcagaaaaccggtgataagaccgaaaaaatgctccgtctggacatggaagcaagtgaagccatgtcgcatatcagccgccgcagtccggcgcggatggacgtggtgtcgctgctgtcggacggcggtgcgatgagccagaaggaaatcgtctacatgaccggcgtgagcgacgccgcgctgcgtgacatgacaaaaaaaggcatcctccgtgcggaatacgaggaagtgctgcgcgcaccggacttttccgaggtgccgcgcgccgcggctccggtgctttcggcggcgcagcagcaggcgtatgacggcatggcggcgctgatggacgaaaacgcgcctcgtgcggcgctgctgttcggcgtgaccggcagcggcaagacgcaggtatacctgcagatgatcgcgcacgcgctcgagcagggcaaaagcgccattgtgctcgtgcccgaaattggactgacaccgcagcttctgcggcagtttgccgcccggttcggcgaggaagtcgcggttctgcactcggcgctgtccaccggtgagcggtatgacagcttcaagaagataaaaaccggcagagcaagggtggtcatcggcacacgctcggcggtgttcgcgcccgcgaagaacctcggcgttatcatcatcgacgaggagcaggacgcagcgtaccgctcggagcagtcgccgcgctaccatgcgcgggatgtggcaaagtaccgcgcggcacagacggacgcgctgctcgtgctcggctcggcaacgccgtcggtcgagacgtattacggcgcaaaacagggaaaatacccggttttcacgctcaccgagcggtttctcggtgccggactgcccgaggtcatcatttcggatatgcgcggactggcccgcgagggacggagcggcatcatcggacctgacctcgagcgcgaactgatcagcacgctcgaaaagggaaagcaggccatcctgttcctcaaccggcgcggcaacagccgcgtgatcggctgcggcgtgtgcggctgggtgccggaatgcccgtcctgctcgaccaccatgacctaccattcggtgtccggccgcgcgatgtgccactactgcggcgcatccatcaagataactggcaagtgcccgcagtgcggcagcacgagcctgttcaccgaaacgcccggcacgcagaagctggaggaggagctgcacgagcggttcccgtccgcacgggtgctccgcatggacgcggacaccatgaccgccaagggcgcgcatgagcgcctgctgaataaattcggcaaaggcgaagccgatatccttatcggcacccagatggtgaccaagggactggattttgagaacgtcacgctggtcggcgtgctcgatgccgaccagagcctgtacgcgcaggactaccgcgcacatgagcgcacgttttcgctcatcacgcaggtggtcggccgcgccggacggcgattcgacaccggacgcgccgtgatccagacgtacagtccgctgcatccggtcatcctgaccgccgcgcggcaggactacgaggcgttctacgagagtgaaatgcagacgcgcgaagcgcttcggtgcccgcccgtgtgcgacatcaccatgataaccgccgtcggtgaactggagcagcaggtgctcagcagtctgctcgcgctcaaaacacgcctgcagagcctgatggaagggcagtttgccgatgtgaaagcacccgtgctcggccccgccgcggcgcagatggtcaaggtgatgggacggtatcgctaccaccttaccatccgtgcaaaggactgtgcaagatggcgcaggctcatctcgggcgtactgcgggagtttatgcaggacggtaaaaaccggggcgttaccgtgttcgcggattccaataatgaaatgtagcagtgattgagaccccggcaaagaaggttaattcaatgagcaaatttgtaattcgcaaggcaacggaaaacgatgcagaatcgcttttgaagatttatgagccttacataacgaatacaaccatcacgtttgaatatgatgtgccgacggctgaggcgtttgcggaccgtatccgcgaaacggcggctgcgtttccgtatctcgtctgcgagcaggacggcatgatcatgggttacgcctacgcgcaccgcattcgtgagcgcgcggcctacgactgggatgcggagctgtccatctatctggcacagggcacccacggacatggtgtgggcacgaccgtgctggcgtgcctgatcgacctgctcgagctgcaggggctgcgccacctgtacagctgcgtgaccctgccgaacgaaaagagcatccgcatgcagcgcagactgggctttgcggacgcaggcgtgtggcacgactccggctggaagtttgacggctggcacgatgtggcatggctggaaaagcatatcggcagcggaaaaccgcagccggtgacgccgtttccggcgctcgatgagaaaaatatacaggaatgtttacaaaaatacatggataagctgaatcaagtggaggaataaaacaatggcactgagaaagattttgaccgagggcgacgagcagctgctcaagcacagccgcaaggtagagaagtttgacgaccgtctgcatacgctgatcgacgatatgcgtgagacgctcgagaactccggcggcgttggtctggcagcaccgcaggtgggaatcctgcgccgcgttgttgtgctgctggatgtgaacaaggagccggaggagatggtcgagctggtcaatcctgaggttatcgagcagaaaggctccgagcgcgttgtcgagggctgcctgtccgtgccgggcgtttacggctatgtgacccgtccgacctgggcgaagattcgcgcacaggaccgcaatggcaactggttcgagcgcgaaggcgagggcattgtagcgcagtgcttctgccacgagaccgagcatctggacggtcatctgttcaccgagaaggtcgaggagtatatcgacccggaggcaatgcagggtggtgacgaggaataatgcgtatcgtattcatgggcacgccggacttcgccgtgccgagcctgcaggcgctcatcgacgccggacatgacgtctgcgccgtgtacacccagccggataagccgcagggccgcaagcagattctcactgcaccgccggtgaaaacgctcgcactcgcgcatgatattccggttttccagccgaataccctcaaaaatgaggacgagcaggcgcgtctgcgcgagctggcacccgaggttatcatcgtagtggcatacggcaagctgctgcccaaggcggtgctcgatatcccgccgcacggctgcatcaacgtgcacggttcgctgctgccgcgctggcgcggcgccgctccgatccagtgggcggtcatcgcgggcgatgaaatggcaggcgttaccaccatgcagatggcggaaggtctggacaccggcgatatgctgctcacctatgagaccaaggtcggtgagaaggagaccgcaggcgaactttttgaccgtctggcacagtccggtgcggaacttttgacccaaacgctcgtcaaattagatgagatcacgccgcgcccgcaggacgatgcgcagagctgctacgcccatatgctggataagcagatggcggtgatcgactggagcaagtccgcacatgaaatcgactgcctgatccgcggcttgaatccgtggccgatcgcgctgaccacgctttccggcgaaagactgaaggtgtttgccgccgaaaaggcaaacggcaatggcgagccgggcgcggtgctcgaagccgacccgaaaaagggtctgaccgtggcgtgcggagagggtgcgctcaaactgaccgagattcagctggtcggcggtaagagaatgaaggcgacggactttctgcgtgggcacgcaatcgaagtcggcactaagctgaattgagaattgagaatggataatggagaatgacgctatccttgcgcgagttccgtccgcgctgcgtctgtgcggcgcatgcgccgttattaaatcatcgtccgtaggacgataccgcaattctcaattctctattttcaattttccattaaaagcatccggagggatttattatgccttactatggatattacggcattgacatgtactacatcgtactggttctgccgtgcgttttatttgcattctgggcgcagaacaaggtaaacagcacgtttaaccgctactcgcgggtgcaaaatctgcggggtctgaccggcgcacaggcggcggaggctgtcctgcggtacaacggcgtttccggtgtgcggattgagtacgtttccggcaagctgaccgaccattttgacccgagaagcaacgttattcggctgtcgagtgcggtgtactcatccacgtcggtggcgtccatcggcgttgccgcgcacgaggcagggcatgcggtgcagtacgccatcggctatgcgccgatcaagctgcgcgcggcgatcatcccgctgacgcagttcggctcgatggcggcgatgccgctgctgatcctcggcctgatccttaacacgagcacgctcgtcacgatcggcattgcggcgttcggtctttctacgctgttccagctggtgaccttgccggtggagctggacgcatcccgccgcgctttgcagaccattcagcagaacggcctgctgaccgcagacgagtacccgatggcgaaaaagacgctcacagcggcagcgctgacctatgttgccgcgctggcgacctcgctggcacagctgctgcgtctggtgctgatttttggaggaagagaccgcaatgatagataaacgccccaaaacaccgcgtgaagtggcggcattctcgctgttttccatggcagaggaggccgcctggtcggacggtgcgctgcaccactatttatcccgcgcgggactggacagccgcgatgcggcgctggcctcgcggctgacctacggcacggtgcagaaccaaattttactggactggtacctgcggcacttctcgagcgtgcggctgaaaaagatcgcgccgcgtgtgctggcgtgcctgcggatgggtctgtatcagctgatcttgatggataagattcccgcgcatgcggcggttgccgagacggtcgcactggtcaagcactacggtcatgcaaatgaccgcacggtcgcctttgctaatgcggtgctgagaaatgccgcaaatgcggcccaaaacggctctttgccgcgcctgaactgcccggataaggaaagctactacgcactgcagtacagccacccggagtggctcgtgcgtctgctttccgagcagtacggtcagaagctgacgcagaaaatctgtcaggcggataacgcggacgcgccgatttcggtgcgcgtgaacacgatgaaatgcacgcctgacgaggctcaggcagagctggaggccgccggactgaccgtgcagccgcacgaggcattcccggaaatcctgctgtgcagcggcggagacgcagccgcgcttccggcgtttatcgagggccgcgtgaccgtgcaggacgcggcaagcgcactcgcggcggcagtcgctgacccgaaaccgggcgacaccgtgctcgactgctgtgccgcacccggcggcaagagcttcgccatggctgaaaaaatgcaggggaaaggcagcgtcacctcgtgcgatatttacgagcacaagctgaagcgcatccgcgacggcgcagctcgcctcggactgccgaatatccgcaccgagctgcaggacgcatcggtctgccgcgaggagtggaaggacagcgcggacgttgtgctgtgcgacgtgccctgctcgggactgggcattatccgcaagaaacccgaaatccggttcaagaatccggacgaaatccagactttgccggagattcaggcgagaatccttgcaaactgtgcacagtatgtaaagaagggcggcacgctcgtttactcgacctgtaccatcctgcagcgggaaaacgaggacgttgtccgcgcgtttctcaccgaaaatccggagtttgaagcggtttcgtggacgcatccggtctgcggagagagagcagacggtatggtgacgctgctgccgcccgttcacaatacggatggattctttattgcgaaaatgcaccggaaggtttaataatggaaaattgagaatggaaaatggaaaatgtcgctatccttgcgcgagttccgtccgcgctgcgacgaagtgcggcgcaatgcgccgttattcaatcatcgcgcacagcgcgataccgcaattctcaattctccattctccattctcaattcaaaggtgaaaataatgactgaaattaaatcattatcaatagaagaattaaaggctgccctgaaggaaatgggcgaaaagccgttccgtgcgggacagatcttcaaatggcttcacgagggtgtggagtcctttgaagagatgtccaacttatccaaggacttacgggcgcgtttagcgggaaatttcctgctgaccgtaccggaggttgcccgcaagcaggtgagccgcgttgacggcacggtgaaatacttatggcgtctgcgggacggcaactgcgtggagtccgtactgatgcactacgagcacggcgtgtccgtctgcgtttcgacgcaggtcggctgccggatgggctgcaagttctgcgcgtcgggactcaacggacgcacgcgcagtctgtccgcaggcgagattctggacgaaatcctgttcatgcagaaggacagcggcgaaaaggtctccaacattgtgctgatgggcaccggcgagccgctcgataactacgacaacgtgctcaagttcctgcatctggtgagctgcccggagggaatcaacatcggacagcgccatatctccttgtcaaccagcggaattgctgatagaatagagatgttagcacgggaaaagctgcagatcacgctgtccgtatcgctgcatgcgccggatgacgaaacacgctcgtccatcatgccggtgaacgatgcgtatccggtcgagcgcctgatgaaggcgtgccggtactatttcgacaccaccggacggcgcatttcctacgagtacatgatggcacgcgacaaaaccgaccgcccgtggcaggccgacctgctggcgaagctgctgaaaggaagaccggcgcacgtcaacctcattccgctgaatgaggtggcggaaagtccgctgaagccgtccagaccggaaaccgtccgcaggttccagcaggcgctcgagaagcgcggcgttaccgcgaccgtgcggcgcaagctgggtccggatattgatgcggcctgcggtcagctccgtcagcggcagctgaaggaggacggaaaaggcacatctcgtgcataaacttaaagcaccgccgctttaattgtgcggtgttgccttaatatctcagcatgaaatagacacaatcgaaggaggttgtgaaatggaatatttcggcttgaccgataagggacgggtgcgcccgaccaatcaggatatttttcagatcgaagcgcgggaggacaaccggaccgcgctcctcgtcgtgtgcgacggcatgggcggtgcaaatgcgggcaacgtagccagccgctttgccgcgcagagctttatcgagtccgcgggtgacgctttaagcggcacgctggacgaaacggctcggcagaacctgctgacgcaggcgctcaagcaggcgaacgagacggttttctctctggcgggcaggcagccggagttccgcggcatgggcacgaccctggttgccgcgctcattcagggcgactgcgcgaccgttatcaacgtgggcgacagccgcgcgtaccgctttgacggcgaagccatgcaccagatcagcgaggaccactcctatgtggaggaaatgcgccgccgcggcaagatcaccgaggcggatgcgcgcacccatccgcagaaaaacctcatcacccgtgcggtaggcgtggagccgtgtgtcgaaggcgacctgtttgaagtgcgcctgaacgaaaaggacatgctgctgctctgctcggacggtctgaccggcatggcggaggacagccggatcgcggaggtgctggcaaacgcgccgacgctcgagctggccggtgacgcgttgctgcagctggcgcttgacggcggcggccgcgacaacatcaccgttgcgctgttcaccctcggcaaaaagcagggagcgtgacgaactatggataaatatatcggcagtatgctcggcggacgctatcagattgaggaaatcgtcggcgtcggcggcatggcggtcgtttaccgggcgcgggataccattctcgggcgcgatgtggcactcaaggtgctcaaaaaagagttcgcggaggacccggatattcgcaagcggttctccattgagtcgcgcgccgttgccaagctgagccaccacaatattgtttccgtgtttgacgtcggcagcgaggacggcacggattatatcgttatggagctgatcgagggcatcaccctcaagcagtatctgcagcgcaagggccatctgtcgtgggaggagaccattttcttcgctgagcaggttgcccgcgcgctcatgcacgcacactcgcgcggcatcatccatcaggacgttaagccgcagaacgttatcatcctgcgggacggtacggcaaagctgaccgatttcggcattgcctcgttcgctgccgcgcaggagacccgcgtggtgcaggaggccatcggctcggtgcactatatctcgccggagcaggccaagggcagcaagatcgattaccgcaccgacctgtactcactcggcgtgatgatgtacgaaatgctgaccggcaagctgccgtttgagggcgaaaccgcgctccagatcgtcatgcagcacatcaatgaggtgccgatcatcccgagtgcgtttgtgccgggcatccccaagggcatggacgatattgtcatgcacgccatgagtgcgcacatcagccgccggtacgagtccgcggaaaagatgtacgaggacatggaggtgctgcgcaccgacccgaacgcacgcttccactatgtggcaagcgaggacaattcgggcgagacgcagatcatcggcgcggacattcagcgtgcggcgcgccgcagtgcggcagagcatgaagccgcttccgttgagggcgcagctgcgccgcgcacccgcacgcgcacgcagacccagacccgcacccgcacccgcacccgcaccggtttccgcaaaaaagagcaggatgagccggacggcttttttgaaaagctggccgaacgtcccggcatggcggtcggcatggcggtcggcgtgatcgcggtgatcagcctgctgctggtcggcattctggtcatcaccggcggcggcgacaagtcggagaagatcatcgtgcccgacctcatcggacgcaatatcgacgaagtgatggccgacccggatataaccgacaacttcacggtaaaggaagcgaccgaacggcaggaatccgaccgtccggtcggtgagatactcgagcaggacccggacggcgacggcaagaaaaaggcaaccaagggtacgatcatcacggtaacggtatcctcgggcggcgaaaacgtcaaggatacctacaaggtgatcgactttaccggcaagacgctcgattatgtgcaggcggcgctggcatcgcacgacatcaagtgcgaggtcgttgaggaatacagcgacgacgtggaggaaggcaaggtcatccgcaccgacccggaggcgggcaccgagctggaaaagggcgcgacgctgaccgtctatatcagcaagggcaagcagaaggacgataacgaaaatgtcactgtgcccggtctgctcggcatgaccgaggaccaagcgcgtgcggcgctggaggcaaagggcttgaagatcggttcggtagactcggttgacagctctgcggaagcaggatcggtcgtttggcagtcgcaggatgccggtgctgaggtgaccaagggcagcacggtcaacatccagatctccaagggcaagagcacatcgaacaataattcgccggataataacagcggcggcaattccggcggtcaggacaacggcgatggcgactacgacgatacgccgagcctcggcagtgcgaccattccggtttcgctgccggacaacacggataccgcgcatgttatcatctatgtggacggcgtaatccagtatgacgacacctgcagcacgagcggcggcagcacgtccatctcggtgagcggctcggtgggcgaccatgatgttacggtcagcgtggacggttcgactacctcgcagacgtacacattcagttaagaaattacgttcaaagcgtaaaaacggaggaattaagtttgatcgaagggatcattctgaagggcatcggcggtttctactatgtggataccgccgagggtctcattgaatgcaaagcacgcggacggttccgcaagaccgtgggcaagcctatcgtcggggaccgggtaacgctggaaatccaaccggaggacggcaccggctatctgcagacgatcgcgccgcgcaagaacagcctgatccggccggctgtggcgaatctggatctggtcgttgccgtggcgagcgcggcaccgccggtgaccgacccgttcctgatcgacaaggtaacggcgatcgcggtgcacaagaacatggacgcactggttgtcatcaacaagacggacgcgaatccgggtgacgagctgtatgaaacctaccgcaggagcggcatcgaggtgctgcgcgtgagcgcgcacaccggcgagggcattgacgtactgcgcgaacgcatccgcggcagggtgagcgcgtttgcgggcaactcgggtgtcggcaagtcgagcgtgcttaaccgtctggacagctcgttcggcgccgaggtcggtgcgatttcggataagatcggccgcggcaagcacaccacccgtcatgtggagctgcacccgatcgaaggcggcggctacatcgcggacacgcccggcttttcctcattcgaaaccgagcagatggatttggttctggccgaggatctgcagtatgcgtttccggagttcgagccgtacatcgggcagtgcaaattcaccggctgcgcgcatgtcaaggagaagggctgcgccgttctcgcggcggtcgagaacggagaaattgcgaaaacccgtcacgaaagctatgtaaagctgtatgaaagtgtaaaggatctgaaggaatgggaacttaccaagggcggcacgcgctgatttttgcggctgcaccggaaaccgattacggttacatccgcgcgtttctgcgcgagcatccggacgcgctcgttgcgtgtgcggacggcggcctgcggcatgcgcgggcgctcggtctgcacccggatttcatgatctccgaccgggattccatgaccgaggtagagggcgacgatgtgatcctgctgagacctgagaaggacgacacggattcgcagagctgtctgcgggaggtgttccgacgcggctgccgcgaggcgacgctcgtgtgtgcgaccggcgggcgcatcgaccatatgctggcaaatctctcgctgcttgaggaagcaaaaacgctcggcggtcacctgaccatcctcgatccgtacaaccgcgttgagctgcatcagggcggacggcaggaattcatcatgccggagacgtttacttacttctcggtcgtgccgatggacgcggtgctcgagggcgtgaccatcgagaatgcaaaatatgaattaacgaacggcacggttacccgtgtcggcatgatctccacctcgaacgaggcaaaaccgaacagccgctttgccgtcacgattgaacggggaacggctctgattatcttctcgcgcgaccgtgttttgtgaaaattccacacctgacccgccaatatcggcgggtttttttattgtgtcgattttgcaatttattaagtcaggacttgcaaaaataagttcgcaggcatataataaaaacacatgataactgatgagagatataagggagtgctgagcatggcattgaagccgatttccaagattgcagcaggtgtgcaggcgtccacgacgctggccattgattcgctgttcaagcagatgaaggcagagggcaaggacgttgtcggctttggtgccggtgagccggattttccgacgccggagcacatcaagcaggccggtatcgaggccattgagaacaaccagaccaagtacacgccggcagccggtctgatggacctgcgcaaggcagcctgctaccgtctgaaggaggactgcggtctggactacgagccgacgcagatcgttgtggcttcgggtgcaaagcactcggtttatatcgcgctgatgacgctgtgcaacccgggcgatgaggtcgttatcgcggctccgtactgggtaagctactccgagatggtaaagcaggcaggtgcaatcccggtcatcgtagccgcaaccgaggaggcgcacttcaagatcaccgcagagcagctggatgccgccatcaccgacaagaccaaggtgttcatgctgaactctccgtccaatccgaccggcatggtatacaccaaggctgagctggaggcgatcgctgaggtttgctgccgccataacatctacgttatcgcggatgaaatttactgcaacctcgtatacgataacaatgagtttgtgtccttcgcttctctgggcgaggacgtgaaagagcgcaccattctggtcaacggcgtatccaagagctacgcgatgaccggctggcgtatcggctacagcgcgtccaatccgcagctggccaaggtgatggcgaactacctgagccactccacctctgcaccgtccaccatttcccagcaggcggctatcactgcactgaccggcccgcaggaggatatgcaggtgatgaagcaggcgttcgagcagcgccgcgaccatctggtagagcgcatgaaccagatcgagggcgtttcctgcatcaagccggagggcgcgttctatgttatgatgaacatgaagggcttcctcggcaagaccatgtacggcaaggtcatcgagagcgccgaggacttcgcgcagctgttccttgagaagggtctggttgcgaccgttccgtgcaccgcatttgccgcgccgggcttcatccgctggagctatgcgacctcgctcaccgagattgataagggtctcgatcgcctcgaggcgtttatcaagaacgcgtaagcattcgtaattccgagcagcactctgaaaagggtgctgctttttggtttctgcaccgaacctcttgggcacttgaaccgcgcaggcggttcaccctttccgggcggcagctttttcagcaccgtctgagtggggaacgcgaactgccgcaggcgggttcgtccctgatgggcggagagtttttcgctgaacctcagcggggagttgcgctctgcggagcgcgggaacgtgcgctgacgccgcgcgggcgcacaagagggtagacacctgcggtttccaccctcttgtgaatcacccctttcccttggatagtctggcgcagcttgccgacatgtgaccgctgcgaaaaggggaacggcagagaattttttctaccgtaggggagcacagtgtgctcccatgtcgagacatattcgcagtgtcggatactgttctgctacacaggcggtttactctgcgcaagcgcgacatatccgtgtcgcgcaactcgttagtctggagattatggacggcacctgcgaattaggcgtttgatactatttatcttcgcaggtgctgtctataataacgtgcccacgaattgcgcggcactgtcatgccgcgcctgcgtaaactaacccacatgtgtagcagaacggtatctgaccctgcgaacaggttacgaaaaacacggaagaaaaaatcctctgccgtacccctgtttcggagcggtcacatatagaaaatctgcgccagattaggaagcaagggaaaggtaggagttcaaagaggaagggaaaccgcaggtgtcccttcctttttgccccccgcggcgggcgccgcgacgctcccgccgtccgcagacggcgaatcccccgctgaggttcagcggaaaacttcccgcccgttaggggcgaacacgctaacgcagttcgcgcgccccggtcagtcggtgcagaaaaagagccgccccgtcagggcgaacacgctcacgcagttcgcgcgccccggtcagccggtgcaggaaaaagagccgccccgtcagggcgaacacgcttgcggcagttcgcgcgccccggtcagccggtgcaggaaaaagagccgtcccgttagggcgaacccgcctgcggcagttcgcgtaccccggtcagccggtgcagaaaaaaggggaggacgcaaaatctaacggcgaaaccgttgcaaactttgtttattgctacaagatagcgcaaaaccggtcggttttgcttgaaatgaccgatgcaaagtgttaaactaaaatcggactgttatggaagattagacaccatccaagtccgttatttcgttataatttggataaaatacacaccggaaaggacgaataacatgaacaacgtgtacgaaagcccgctttcctcgcgctacgcatccaaggagatgctctacaccttctcctcggatatgaagttctccacctggcgtcggctgtggctgtcgctggctaaggcggagcgggcgctcggtctgccgatcacgcaggagcaggtggacgagatggccgcgcacctgaccgacatcgactacgatgtggcccgtcagcgcgagaaggaggtacgccatgacgttatggcgcacgtttacaccttcggcaaggcggctcccaaggcggccggcattatccacctcggcgctaccagtgcgtatgtcggcgacaataccgacatcatccagatccgcgagggtctgctgctggttcgcaaaaagctggcgaccgtactggacaagctggcgcagttcgcggatgcgcacaagtcccagccgaccctcggcttcacccacttccagcccgcacagctgaccaccgtcggcaagcgcgcgaccctgtggatgaacgagctgctgatggatttgaacgaggtagaataccgcatcgaaaacctgcgcatgctcggcagcaagggcacgaccggcacgcaggcgtccttcatggagctgtttgacggcgacgagagcaaggttaaggagctggagaagcgcattgccgatgatttcggctttgcaggcgtggttccggtctccggccagacctactcccgcaagatcgacgcgcagacgctcgcaacgctcgccggtatcgcagaatccgcttccaagttcgcaaccgacctgcgtctgctgcagcacctgaaggaagtagaggagccgttcgagaagaaccagatcggctcgtccgctatgccgtacaagcgcaacccgatgcgttccgagcgtatctgcgcactggcgcgctacgtcatctgcgacagcctgaacccggcgttcacctcggctacccagtggttcgagcgcacgctcgacgactccgcgaacaagcgcatttccgtgccggaggcattccttgccgttgacgcaatcctcaacatcatgattaacgtcgtttccggtctggtcgtttacccgaaggtcatcgaggcgcacgttatgaacgagctgccgttcatggcaaccgagaacatcatgatggacgccgtaaagcgcggcggcaaccgtcaggatctgcacgagcgcatccgcgagcactccatggctgcgggcaagcgcatcaaggaggagggcctggagaacgatatggttgaccgcattgccggcgatccgatgttcggcatgacccgtgagcagatcctcgagcacctcgacccgtccgcttacatcggccgctgcccgtctcaggtagacgagttcctgagcgagtgtgttcgtccggcgatcgcgccgtacctcaccggtgaggacgtaaaggtagagatcaacctgtaaaccggaaagtttatccctgaaattgacagatatcccgctcacgcgggatattctgccgcttatgcgtcaatggcgcataaatgttgcacaattcatgcagaatgattgactttttggctattatgctgtatactaaatcagttgtgtaacaaaaaaattaaaggaggcacttgcaagtgaaaaagagtgtaacttcctttatcgcggtcatgctgatcatcattttcctcggcgtgacggcggtaacaggagtgtacattccgggcggctggaccatgccgttccggaacacggcaacgtccgacacgtctgcgacggatacgagcgatacctcgtctaccgacagcagcgcagacaaggcggacaacacggcagacagcacggatgcgtctgctgacacctctgctgactcggcttcgaccgattccgcagacacgaaagactccggtctgaaggccatcatcccgagcgtactcgataccgacaacggtatccgtctgggtctggatctggtcggcggctcccgtatcgtatacgaggccgaaatcccggacggctacgacatgaacaacctgtccgacgacatgaactcggtacagaaggtcattcgtcagcgtctgaccgacaagggctttaccgaggctaccgtatccctcagcggcgacaaccgcgtaacggtcgagatcccgcagatcaccaacccggaggaagcggttcagaccctgggcaccaccgctcagctgaccttcctcgatgccgacggcaaggagtggctgtctggctcggacatcaagaaggcgtcctacggctacggcaacccgaccaacggcatgtccgatcagcactacgttgaggtgcagttcacctccgagggccagaagaagttcgctgaggcgaccggctccgttgctgcccgcacggacggcaccaacattctgtacatcatgatggataaccagatcatctcgtatccgtctgtttccgagaagatcgacaacgacagctgtgttatcaccggcaacttcacccgcgacagcgcgaccgagctggcaaacctcatcaatgcaggtcagattccgttctcgctcaagcaggtagagcttcgctctgtcggcccgcagctcggcgctgacgcgatgagctccagcctgaaggcaggcctgatcggtctggtactcgttatgctgttcatgatcatcatgtaccgcattccgggcgttgtttcctgcttcgctctgtgcttctacatggttatcgaggcgctgctgttcagcctgatccgcgtaaacctgtccctgccgggcattgcaggtatcatcctgtccatcggtatggcggttgacgcaaacgtcattatctttgagcgcatcaaggaggaaatggctgccggcaagaccgtcaagagcgccattgactccggcttcaagcgtgcgttcaccgcaattctggactccaacatcaccaccctgatcgcgtgcggcgtgctgttcttccttggcaccggcacgatcgtcggcttcgctaccacgctgggcatcggtgttatcgtgtccatgttcaccgcgctgaccatcacgcacttcctgctcagacgcatggtggatttccacatccgcaatccgaaggcttacggcctgcgtgagcgcaaggaagagaagaagcatttcccgatcctcaagaacttcaagatcttcagcggtatctctgtcgtactgatcgtaaccggccttgttgcgctgatcctgctgccgttcggcaagaacctgttcaacctgagcatcgactttgccggcggtaccgagatggagttcaacatgcacaccgccgttacgcaggatatccagaccgaggtcagcgatctgttcaaggacgcaaccggtgtggacgcatcctctgtaacctcctccggtgacggcaacgaggacgtgctgatccgctccacctcgattgattccgagcagcgtgctgccgtgatcgacaagatgctgaagcagtacagccttgccgataccgatatcctcaacaataacgacgtatccgcttctgtcggcagcgacctgcagcgttcggcattcatctgctcgatccttgcaatcctgctgatgctggtgtacatcaccttccgcttcgagctgaccagtggtctggctgcgatctgctgcctggttcacgacctgctcgttatgctgagcgtttacgttctgctgcagattccgctcgacagcaacttcattgctgctgcactgaccatcctcggctactccatcaacgcgtccatcatcgtattcgaccgcgttcgtgagaacctgcgcaccgcgcgcaaggagccgtttgaggtcatcggcgagaagagcatctggcagaccatgggccgtaccatcaacaccacgcttaccacgctgttcaccatcggcatggtatacatcctcggtgttccgtcgctcaagcagttcaccctgccgctgatcgtcggtatcctggccggcggctggtcgtccgttatgctttctaccggtctgtggggcttcttccgtaagaagttccgccgccgccgcaagatctaacgactatcgaaaaggcacccgttggggtgccttttttgcgtccgtttatcggcgcagggggagcgggaaacacgaacccgcctgcggcagttcgagtaccccgctgggtcggtgcagaaaagaagccgcccggagggcagtgcaggaaaaggtgccgctttatcacaataaaaaattgacttaacagcaccccgcgtagtataataacagcagacagataacaaaccacgcgcgtgaagcggtgttcacaagggggaagtacgatgaagtgcccattttgcagctttgaagacagcaaggtcgtggactcccgtccgacggacgagggtaccagcatccgccgccggcgtgaatgtctccactgcggaaaacgctttaccacctacgagacggtggagcgcatgccgcttatgctgatcaagcgcgatggcacccggcaggcgtacgaccgccagaagctgctcaacggtctggtgaaggcgtgcgagaaacgcccggtttcgctgatgcagctggaacagatcgtcgatcacgtcgagcagaagctgttcggctcgctcgaaagcgaggtctccagcaaggtcatcggtgagcttgtcatggagcagctgcgtaaggttgatgaggtcgcgtatgtgcggtttgcctcggtctaccgccagtttaaggacatcaacacctttatggaagagctgaatacgctcctcaaagataaataattcggcgggtatggcgcaggctgtacccgttttttcatatcgaaaggaagatggatttatggacgaacggctgcagaaacagctgaatttcattctcgagatcgacaaggagaagaacattttccggcagacgcatctctccggccacggccgccgcgagaacgacgccgagcacgcatggcacatggctgtcatggcgtacctgctgcaggaatattccaacgagccggtggatgtggcgcgcgtcatgctcatgtgcctgctgcacgatgtggtggagattgacgcaggtgacacctacgcctacgacaccgacggtctgaagacgcagaaggcgcgcgaggacgcggcaaagcagcgcatttattcgctcctgccggacgaccagaaacgcgggctgatggctgtttttgacgaatttgaggccgacgagaccgccgaggcgcactttgcccacgcgatggacaatctgcagccgcttctgctcaacaacagcaacggcggcagcgactgggccgaccatgatgtgaccgccaagcaggtctacggccgccagagccgcacggagaaaggctcggcgtacctgtataagctgacggataacattctgcaggcgaacatcaaaaagggtgcgctcaaagagaaataaaaaataagaagaattttcgaccgagttgaccatttgtggtcaattttcgccgccgaacggcgtataggtgcaggcacttatgcgaagcaaggaggtgaaaacgtgtcagctgagatcatcattgcgggactgagcctgctggggacgctggcgggcacggccggcggcattatcgtctccggcaagctggtcaattaccgcatcgagcagcttgaaaagaaggtcgaaaagcacaataacctcatcacccgaaccttcaggctggagcaggcagtcgcgctgctggacgagcgtgtccgcgtggctaaccaccgcatcagtgatttggaaaaggaggaagtcgagtgaactggaaggtgcggcttagaaatccggtattctgggtgcagattgctgtgagcgcgttcgccgcggtgctggcgtatgccggtctgaccgccgctgacctcaccacctgggagagcgtcggcgcgctgctctgcaatgcggtgcacaatccgtattgcctgttccttgtgctgtcgagcgtgtggaacgccgtcaatgacccgacaactaagggtgtcgcggacagcgaacgggcaagaagttatgatacgccaagcaggtaaaggaaaatccctctcggaaacgagagggatttttcgttgtgcagaatggaaaattgagaatggaaaatggaaaatgaatggatagtgcaggttggtatgaaagccggtgcataccgtaaacaaaggacgcgcaatgcgtgtccaaattccaacaaatttgcacaatataaatgaaaaaatggagaatgctccatctaaggttcattctccattctccattttcaattctcaattatttagaggatttctttcaatgctgcaatcagcttatccatctgctcatccgtgccgacggtgatacgcaggtaattatcaatgcgcggcagcttgaaatagcggataaagatacccttttcgcgcagggcggcgaagatatccggcgctttcttgttcggatgggtgacaaacaggaagtttgtcagcgacggcagcacggtaaagccgagcgcccgcagcgcctccgccgagcggtcgcgggtggtgctgaccttgcggcaggtctgctggaaatagtcctcgtcgcggatggatgcctcaccgacagcgagtgcgatggcgtccatcgtgtacgagttgtacgagtttttaaccgcctcgagcgtggaaatcagcgtctccgagccgagcgcatagccgatgcgcatacccgcgagcgagcgcgacttgctggttgtctgcacgatgagcaggttttcgtatttatccagcagcggaaccgcgctctgtgcgccgaagtccacatacgcctcgtcgatgatgacaacgcagtcctgattgtgctgcagcaggtcctcgaggaactcgagcgttacgccgcgtccggtcggcgcgttcgggttcggcaggacgataccgccgttcggcttgtcgtaatcacgcacattgacgcagaaattctcgtcgagcggcatgttttcgtacggaatgcggaacagatcgcaccagaccggatagaacgagtaggtgatatccggatagagaatgggcttgtccgagcagaagaacgactggaacgccagcgcgagcacatcatccgagccgttgccgaggaatacctgcgacggctgcaggtcaaaccgctctgcgatagcggttttgagtgctttcgcgttcgcatccgggtaaattgcgagttttgcggcgtcaaacgtgcgcagaacctcggtcacgcccggagcgggcgggtacgggttttcgttggcgttcagcttgatgatatcggcggttttcggctgctcgcccggcacatacgggtcgatcttgcgcagcttatcgagaaaaggcttgtccatgggaagacctcctgtgttcgttttctttgatggggatagtttatcataataaagtgataaagtcaagagggtttgtcgataacgaaaatttgtgatataattcataacatatgaacgataatcgtagggcgcgacgactcggcgcgccgcgttgaacggtatacagatggtttacaacggcgtgccgaggtcgtcctccagaggaccatctcttgccctgcagggcaattcaccttgtcacgccctacgaaaaaaatggttaaggtgaaattatgtaccaacctttagcagacaaaatccgtccgaagactttggacgatgtggtcgggcagcggcatttactgggcgaaaacggccttttgcgccgcgtcattgaaagcggcagcatcccgaacctgatattttacgggccgtccggcgtgggcaagaccacggtcgcgtccatcatcgcgcagcagaccgaccggaagctgtaccacctgaacgccaccacggcgggcattgccgacatcaaggcgatcattgacgagctggacaccttccttgcgccgaacggtgcgcttgtgtacctcgatgagatccagtatttcaacaaaaagcagcagcagagcctgctggagttcatcgaaaccggcaagatcacgctgattgcgtccacgacggaaaacccgtatttttacatctacaacgcgattttaagccgctgcacggtattcgagttcaagccggtcgaggctgccgatatgcgccgggcagtggaacgtgcgttgaaacttgcgatgggcgaggacgcaaagccggtcgaggatggtgtggtggattacatcgcgcaggcggtcggcggcgacgtgcgaaaggcgctcggcgcggtcgagctgctcgtctccggcgcgggggcggacggcatcacgctcgcggacgcgcagcaggcggcgcagcgctcgaatatgcgctacgaccgcgacggcgacagccattatgacatcctctcggcgctgcagaagtccgtgcgcggctctgacccggacgcggcgctgcattatctcgcacggctgctcgaggcaggcgatatgatctccgcggcgcggcgcatgcttgtcattgcgagtgaggatatcggtttggcgtacccgcagtgcgccgccattgtcaaggcgtgcgtagacagcgcgttccagctgggattgcccgaggcgcggattccgctcgcggaagcgatcattttaatggcgaccgcgcccaagtccaacagtgccatcaacggcattgatgccgccattgccgacattcgggcgggcagggcaggcgatattccggcgcaccttaaggatgcgcattacggcggcgcaaagaaattaggccgcggactgacgtatcagtatccgcatatgtatcctaatcactgggtgcagcaggagtatctgcccgaggagctgcgcggcgcacaatactacgaatacggcccgaataagaccgaacaggccgcgaaagcgtactgggatagagtgaaaaatcagaaataatggaaaatggagaatgaacgtgacggtttcattctccatttttttcgctgttcactcgaaaacggttttaaccggctttttatcgcacccaaccggcgtataggtccattcatcaatgtgtccgtcggtgatgaaataccgtggcggtgtcggtgcgtcatacggcgcgagaacgtcgatgacggtcagctttaccttcatccgctgcggcaggatggacttgatgtacacggataccgccatgccgggccgcaggtctgcgcgcggctccgcgaggccggacaggttgggcgtaagctcgatgaacacgccgtacggctcgatggagcggacaacgccgcgcacggtctcaccgacggagaacagcgccgcgttctgcgcccaggtgccgagcagctcgcggtgggtgagcgaaatgcgccggttttccggctccacggtgcggacagccgccagaatggactgcccgacggtcaatcggtcgcccgggtggcagatgcgcgacacggacagattttcgatgccgatgagcgacggcacgccgcagcctgcgtccacgaacgcgccgaacggctccagatgcgtcacacgcgccggaatcacgtcgcccggacggagggaatcgagcagccggtcctgcgccttctgctgaacgatggtgcgcgacagccatgccgtgggcgggtccgtgctttcgtcgatatcggtgacgacgaagcaggtgggcttgcctacacgcgacaggatggcaatctcgcgcgtgtcgccctccgccacgccgagcgcgcaggacacgcgcggcaggatgccctgcgcgatgccgaggtcgaacagcaggtcgtgcgcggcggtgcaccgctgtgcgacggcttccagaatacgtccctcgtcctgcgcctgccgcagtgcgccgagcgttgaaaatgcctgccgaaccgcaggctgtaccatgtagctgccctcgggcagataggattcgcttgttttcatatgcagccgagcctcctttggggtctgccttactatatgatgtgcggtgacggattagcaccgaattgtccgtatcggcatagattgtaaccagaatctatggataaggggctgattggaatggccaattcggcaaatatttcgctgtcggcgctgcgggacggacagcaggcgcgggtcgcagcgctgcatctcagcggcggcatgcggcggcgcgtgcaggatttagggttagtgccgggcacgcgcgtaacctgtgtgcggcgtgcgctctcgggcgacccaatcgcgtactggatacgcggcgcggtggttgccctgcgtaaatgcgatgccgctcaaatcgaggtgcagccatgaggcgcaccgtggcgttggcgggcaacccgaacgtcggcaaatcgaccgtgttcaacgccctgaccggcagccgtcagcacaccggcaactggagcggaaaaacagtcgcgtgcgccgagggcaggctgcgcggcggcggtctgacgctgaccgacctgccgggtacttattcgctgcgggcgcactcggaggaggagcgtgccgcgcgggaatttctggtttcgggtcaggcgtgcgcggtggtgctcgtggcggacgcgggctgtctggagcgcagcctcatccttgctttgcaggtgctggaggtgcagaaaaacgccgttctatgcctgaatctcatggatgaagccgcgaaaaagggcattgagattgatgctgccgcgctcgagcgggagcttggcataccggtgataccgtgcgccgcacggcagggaaaggggctgcacgagctcgaagccgcgatacgccgagcggcggcaggcgaaaatgaaacgcacccgaccgccatccgctatccggcgatggacgaggatttgacggaggaacagagggacgatattgcaaccgcagcggcggcactccgcgcggaggagatcgcgctgacgtgcgtcagacagccggaatgcgcctgcgcgcgggatgaccgagcggacgatgtgatcctcagccggaggttcggcgtgccgctcatgcttttgctgctcgcaggcgtgttttacctcaccttattcggcgcaaacgtgccgagcgagtggctgagcacgcatcttctggcactcggcacgccgtttgcgggtgcgcttgcgaagctgggactgccgccgtttttcgtctcgatgctgaccgacgggttatggcgcgtactggcaactgttgtctcggtcatgctgccgccgatggcgattttcttcccgctgttcacgctgctcgaggacgcaggctacctgccgcgcgtggcatttcagcttgaccacgccttccagtgcgcgagagcgagcggcaagcagagcctgaccatgtgcatgggcttcgggtgcaacgcctgcggcgtgacaggctgccgcatcatcgactcgccgcgggagcggctgattgccatcctcaccaacagctttgcgccgtgcaacggacggtttccgctgctcatttttctgtgctcggtgtttttcgcgggcagcgcggcaggcggcgcgctgctgctgaccggcgtcatcgcggcaagtgttggcttgacgctgctcgtgtcgcgcattctctcggcaacggttttgcgcggagaggcggtgtcgtttgcgctcgagctgccgccgtaccgcatgccgcagatcgggcgcgttatcgtgcgcagcgtgcgcgaccggacgctgttcgtccttgcgagagccgccgccgtggcggctccggcgggcgtgctcatctggctgcttgccaatgtgcagatagggaatacagctatcctgtcgcacatcacggcatttttagacccggcagcgcgggtgttcgggatagacggcgtgattctgcttgcgttcatcctcggctttccggcgaacgagctggtcatgccgctcatcgtgatgggctacctttcatccggcacgattgcctccggcgtggactttgcctccttccgcgcgctgctgctggcaaacggctggacggtgcagaccgcgctctgcacactggtgctcactgtggcgcacgcgccgtgctcgacaacctgccttaccatcctgcgggagacgcgcagcgcaaagtggacactggcggcggtgctgattcctgcgggaatcgggcttgccctttgcatactgatacactgcatgtttacaccgacaggctgaaaagcaggcagaaagtgcgttttttttttttttttaaggtaaaccgtgtaaaaagttaaaaaatctgcattttcaaaacaaaacagcttgcataaaactgtaaagaatgttatcatactaatggattcttttagcgttatccctgccggttttctgccctgcagacctcggcttttatgcatgcagatgcatgcaggaacacgatttgttttatgtggcctgtgatcaatcaatcacggcatctattgcttgaccggcaggaggttttagcacgaatgaaagagaaaagcacgattttgatcgtagatgattctgaactgaatcgcacggtcttagccgatattctgggtgacgaatacaattttatcgaggcggaaaacggcgcccgcgcgatcgagctgctgcggacgcacaccgatatcgaccttatcctgctggatatggtcatgccggagatgaacggctttgacgtactgaccgcgatgaacaacaaccgccagatcgaggatatcccggtggtgatgatctcggcggagaacggcatcgagcacatcgagcgcgcgtacgacctcggcgttaccgactatatcagccgcccgttcgactgcatggtcgtgcgccgccgcgtggtcaacgcgctgatactggctgccaagcagaagcggctgatgcggctggccgccgagcagatttacgaaaaagaaaagatcagcgacctgatgatcaatatcttcagccatattgtcgagtttcgcaacggcgagagcggcccgcatgtgctgcacatccgcaccattactgaggtgctgctgaaccgtctggtgcagaagaccgaccgctattcgctgacgcaggaggatattcagctgatctcgagtgcgtccgcgctgcacgatatcggcaaggtcagtattccggatgagatcatcaacaagcccggcaagttgacaaaggaagagtttgagatcatgaagtcgcacacgacggtcggcgcggatatcctgcacgacctgccgttctcgaatgaggagccgctgctcaagaccgcgtatgagatcgcgcgctggcatcacgagcgttacgacggccgcggctatccggacggcctgaccggcgaggagatcccgatcgcggcgcaggtcgtttcggttgccgatgtgtacgatgcgctgacaagcgtgcgctgctacaagtccgcgtatgaccacgagaccgccctgcggatgatcgtaaacggcgagtgcggcacgttcaatccgctgctgctcgattgcctgctcgatgcgtcgctgcagatcagggagcgtctgctcaaggcgaacgagggatatacgcacagcacggcgcgcacgcagcagctttcgaccgaaatgctgctcaagcaggcgacgccgcaggtcgggcgttcgattcaggcgctcgagaccgagcgcatcaagaccgagttctttgccaagcagtcctgcggcattcagttcgactatgacgcggcaacgcgcaccatctctgtgacggaccacacggatacgctgccgtttgccagccgcctgtatgatgcggcggatacggaaaaattcacaatattcagcaaggatgacctgaaccgcctggaaaacgcgctgtctgccaccacgcgggatgctccggatgtcagcatgccgatcaccctgcggtttccggaggtcggctgggaacacgagtacatgctcacggctcgtgcactctggtcgagtgacgccaagccacggtatctcggcgctgtcggtcagttccgcgagccgcagaccgatatcatgctgccggagatgcagctgccggattccggcgctgtcaccggcaggcagcttgcggattccatgcagggcatgagccgcatttttgatgtggtgcggctggttgatccgaaaaggggcgaactcctgcagctgaatgcggacggcacgttctcggaccgcgtcctgccgtgctttccggtgtgtaaccacggaaagcgatgcagcagatgcatttcccgccgctgcatggagaaaaagacgcgcatgagcaagctggagcttaccgacgagtgcgcgtatcagctgatttcgcgctatctggtcgtggacggacgcgagtgcgtgctcgagctgggcagcaggatcagcgacagcgtttgggtgacgagcggcggacggcagttccggctggatgcctcgcacggagaggatttttatctggacccggtgacaggcgcgtacgggcgccgctacctcgaggatcagcagctcgagctggaaaaggcggaggcactggcggtgatcgacattgacaactttaaggagatcaacgacgaatacggccaccttgcgggcgacgcggtgctgcggcacgttgcgaatgtcattctcgcgcgcgtcaacacagcggacacactcgtccgctacggcggcgatgaatttgtgctgctgctgtcgcatatcccggcggagaaattccgttcgacactcgagcgcattcggggagccgtgtacacaactgaaataccgcagtacgagaatatccacccgaccgtcagcatcggcggtgtgtatcaggcgcatccgctgctcgaggccatccgccgggcggacaagctgatgtactgggcaaagcaaaagcgcaacgacgtacagacctgaggaggagtacatacatgaatctggaagagttttacgcacagatcggcggcgattatgcggacacgctgcagcgcctgtgcaatgagaacatggtgaaaaagttcgtgaagatgtatcaggacgacccgacctgcgccgacctgcacaacgcggccctgcagcaggactgggaggctgccttccgcggtgcgcataccctcaagggcgtagcgcagaaccttggctttgagcggctgtatcaggtcagcgctgtgctgaccgaggccatgagaggcaataagccgctcgaggacaggagcctgctcgacgctgtggagcagcaggatgccgcaatccgcagagcgatttcggagctggagtaaaagcaaaggacgaaccgttggttcgtccttttttcttgactttaccggataaagtgggtatcctgaacttaaggtaataccacataattgcacaagagcgatttgcgtaaagcgccgcggcagcgcgaccggagcctgcgcaaggagccgcagctttaattatgtggtattgcctcaagtaaaggaggaaaaacccatgcaggtattggaaaacgaacgctttcgcgtggaaattaacgaattcggtgccgagctgacccgctttacgagcaaaaaggacggcacggagtacatctggaagggcgatccggcggcatggaagcgccatgcgcccattctgttcccgatcgtgggacggctcaaggacaagacctacaccgtggacggcaggccgtatgagatcacgcagcacggcttcggacgcgatctgacgtggcaggcacagaaaatcagcggcacctgtgcggaattcacgctcacgccgagcgagtacacaaaaaagatgtatccgtgggattttatctgcaccgtgcgctatactttggacggaaatgcgctgaaaaaagagcatatcgtcaagaatacgagcgattccgtgatgtattacgaggttggcggccatgacgcctacacgctctgctgggaggacggcgagaagataaccgactactatgtggagtttgagggcacggatgcgctcagccgcattgcaaccgacgagaatgtcatgctgaccgccgaccgcgtttccgttccgttgaccgacggcaggctgccgatttcccgcgagctgtttgcaaacgatgcggtcatgaccgagggtctgccgttccgcacggcgaccattgccagcacgaagaaccgccgccgtgtgacgatggacttcaccgacttcgactatttcgcggtgtggagcccgtataaggatttcgaggtgccgttcgtctgcctcgagccgtggagtaccctgccggacggcaatcaccttgaccatgccatcgagcacaagcagggcatccgcaaattgcacccgaacgaaagcgaaaccctgacgttcaccaccatcatcgatgaataagttatccaccgtctgtggataaaaaagaggactgcgtttgcagtcctctttgctttactctgcgctcgaaagcatgagtttgattcgattttcctggttaattttcgacgcgcccgggtcgtaatccaccgcgacgatattcgcctgcgggtacacctcgcggatttttcggatcatgcccttgcccgcgatgtggttcggcaggcagccgaacggctgggtgcagacgatgttggtcacgccttcgctgatcagctcgaccatttcggcggggagcagccagccttcgcccatcttgacgccctgaccgataatggcgtgcgactttttgcgtacctcgtcaaacggcatcggcggacggaaatgaccgtctttcttcatcattttgatgatatcggcctgcttgccgagcacaaactggtacaccatcttgtagacggcggcggttttgccgttgcggctgtacagctcgtggtcgatgaccgagttgtagatgcagtacaggcagaagtccatcagaccgggcagcaccggctcgcagccttcgctgagcaggaattcttccagacggttgttgccgagcggcgagaacttgacgtagatctcaccgacgatgccgaccagctttttcttctgcgttttatccagcttcagcttgccgaatacggtcagaacgaaccggaacaggtgctttacctcgccgtagcgcaccatgcgctcgccggtgaagcgcttgatgaccgcgtccatgcagatgtcaatcgccttgtcggtcgagccgggcacaacctcgtacggacggcactggttggcgaccatcatgatcagatcaccgatcagaagtgcatacgccacctgcaccagcatggtcttggtcagcttgaagccggggttgctctccagaccggaaaagttcagcgaaatgaccggaatgaagccgtagccgttcttttccagcgccttgcggagcaggtggatatagttggacgcacggcagccgccgccggtctgcggcaggatgagcgcgattttgtgaatgtcgtatttaccggactcgatggcatccatcagctgaccgatgaccagcagggcggggtagcaggtgtcgttgtgcacgttgcgcagaccctgctccgcgatgttcggaccctcggtgtgcagcagctccatgtcgtagccgtagtttttcatcaggcggcagatgagtccaagctgcacgggcagcatgttcggtaccagaatcttataggtttttcgcatttcctccgtgaactgcgggtaggaatatgcgggcgttgcctcaggcgttttgctgttctgcaagcttgcgtccctcctctacggcggccagcatgctgcggatacggatttttgccgcaccgaggttgctgatctcgtcgattttcagctgtgtgtaaattttgccgccgttttcgcagatggcgcgcatctcgtcggtcgtgatggcgtcaatgccgcagccgaaggacaccagctggataagctgggcgttctccttctgggtgacgtacttggctgcgccgtacatgcgcgagtggtacgtccactggttgagcacatgcacctcgggtgcatcggtcagctgccagaccgcatcctcggacacgatgaccagaccgaacgacgcgatcagctggtcgatgccgtggttgatctccgggtcaacgtggtacggacggcctgcaataacggcaacgtcaaggtcgtgctcgtccgcgtagcggatggcgcgctgaccctcgatacgaacgtcaatgtagtattcgtcctgcgccagatacgcctcctcgacagcggcgatgacctgctttttcttgatctgcgggtacttgccgcagaaatacttaacggcgtgcttggtgaagcgctttttgtccgcgagttcaaagtacggcatcataaagtcgaagtccgcgagtgcggagacgttcgccttcaaaagctccggatagtaggcaacgaccggacagttatagtggttggtcgcgcgttcttcatcgaggttgtaggtcatgcacggatagaagatcgcgtccacgcccttctcaagcaggttctcgatgtggccgtgcatcagcttcgccggatagcaaaccgtgtcggacgggatggaatgctgaccctgcatgtacatatcgcgggtggaaacgtcgctgaggacggtctcgaagccgagtttacgcaggaatgccgtccagaacggcagcagttcgaagttgttgagaccgaacggcagaccgatttttgcaatcgggtttgcaatgccggacggctcgccgtagcttttcagcttttccagcttccatttataaaggttgggcaggtcggcctttttcgtgccgccgagcggacgctcgcagcggttgcccgaaatgaagcggcggccgccgccgaagtcgttaatcgtcagattgcagtggttctcacacagaccgcagcgcgtggagcgcacgttgtgctcgaagcctgcgaggatatccgtgccgatgagcgtggtggtgtcgcggcggttgtccttggcgtgcagtgctgcaccgtaagcgcccatcagacccgagatagccggacgggtcacgtcgcggccgatctcctgctcgaacgagcgcaggatggcgtcattgaggaacgtgccgccctgtacaacgatgtgctgaccgaggtcgtccggcgagtgggcgcggataaccttgtacagcgcgttcttgacaacggataccgacagaccggcggagattgcatcaatgcccgcgccgtccttctgcgcctgcttgaccgaggagttcatgaacaccgtgcagcgcgaacccaaatcaatcgggtgctgtgcaaacagacccagcttgcagaactcctcgatggagtagcccatcgagcgggcgaacgtttcgatgaacgagccgcagccggacgagcacgcctcgttgagcgaaatattgtcgatgcacttgttgcggattttgaagcacttgatgtcctgaccgccgatgtcgatgatgaaatcaacatccgggcagaaatggcgcgccgcgcggaagtgcgcgaccgtctcgaccagaccgaaatccacgccgaaggcattctggatgagcgcttcgccgtagccagtgaccgccgaggacacgatatgtacgcggtcgccgcacagctcgtacaggcgggtgagctgctcgcggataacgtccgccggattgcccttgttggactggtagtggtggaacaaaatctggtcgtccgcaccgatgagcaccagcttggtggtggtggagccgcagtcgatgccgagatatgcgtcgccctcgtacatggtgacgttctgcgtcatgacatcgtgcatggcgtgacggttcttgaattcctcgtactgctgctcatcctcgaacagcggcggcaggtagttggcaacgaccggagcgtctgccgccttttcgagcgccgcgagcagcgaatcgaccgtgtaggtcttctgcgtgccgcctgcgtattccgccgcgcccgctgcgatggcatacggcgcgagagccgggaagtgcgcgtgcgcgtcatccagcttcagcgtctcctgaaagcgcttctgcagacccttgaagaagaacagcgggccgccgaggaacagcacatcgcccttgacctcgcggccctgcgccagacccgcaatggtctggttgacgaccgcctggaagatggacgcggcaacgtcctccttgcgcgcgccctcgttgagcagcggctgaatatccgacttggcgaatacgccgcagcgggatgcgatggtgtagatgcgctccgcgccctgtgcgagttcatcgagctcggacggcgtaacgtccagcaggaccgccatctggtcgatgaaagcgccggtgccgcccgcgcaggagccgttcatgcgctcctccagctgaccggtgaggaagacgatcttcgcgtcctcgccgcccagctcaatgacaacatcggcctgcggaacgtgcacgcctaccgccttgcgggtggcgaacacctcctgtacaaaatcaatatccgcggccttcgccacgcctaaaccggccgagccggtgatcgaacagcggagcggtgtgtcctcgccgatgagctcgcgcgccgcgcgcaccagctcgaccgccttttcacgcaccttggaaaaatgccgttcgtagtgcttgtggataatctctccatcgcggacaacgacgatcttgacggtcgttgagccgatgtcgattccaacatttacattcataatacccttgatctctcccataacaaaacagagcgccgttcaggcaataataaggtatcgccctggcgcaaagtgaatgcgggtaagtgctgccgtgcgtcagcctgagaaggccatatgatgtgataaatatgcagggcaaattcttacctctattactataacggtgcaagcggaaaatgtcaatgcggcgattttctccttggctgccgaaaataccccttgacaaagccggaaattttatataaaatatacggcgtaagtgaatacatgtccttatcgagagcggtggagggaacggccctgtgaaacccggcaacctgcgttgttttgcaacgtaaggtgccaaatccggcgtaagaatacgaaagatgagggagcaaaacgaacttttcgctcccgctgaggagcgttttttaatgctctgaaaatgaactggagaaaggaactgatacttaatggcacatcattttttcacctcggaatcggttacggaaggtcatcccgataaaatctgcgaccagatctcggacgcgatccttaacgagattttaacgcaggatccgtatgcccgcgtagcctgtgagaccacctgcaccaccggtatggttcaggtaatgggcgagatttccacttcctgctatgtggatatcccgaaggttgtccgcgacacggttcgtgagatcggctacgaccgcgcgaagtacggctttgactgcgacacctgcgctgtcctgactgcgatcgacgagcagtccgccgacattgcactcggcgttgacaactccctcgagcgcaaggagggcgccgctgaggccggcctcgccatcggcgcaggcgatcagggcatgatgttcggctatgcgtgcgatgagaccaaggagcttatgccgatgccgatctctctggcgcacaagctggcaaagcgtctgaccgaggtacgcaagaacggtatgttcgactacctccgtccggacggcaagagccaggttaccgtggagtatgacgaggacaatcagcctgtccgtgtggatacggttgttatttccacccagcacagcccggaggtgtccctcgcgcagattcgcgaggacatgatcgagcaggtggtaaagaaggtcattccgtcccatctgctggatgagaataccaagtatttcatcaacccgaccggccgttttgtcatcggcggcccgcacggcgactccggtctgaccggccgtaagatcatcgtcgatacctacggcggcatcggccgtcacggcggcggcgcgttctccggcaaggacccgaccaaggtggaccgctcgggcgcgtatgcggcccgctgggttgcgaagaacatcgttgcggcaggtctggcaaagcgctgcgagattcagctggcgtatgccatcggcgttgccgagccggtttccatcatggtagagaccttcggcaccggcgttgttggcgacgatgtgcttgagaaggccgtagagaaggtgttcgacctgcgtccggcggcgatcatcgagcagcttgacctgcgtaagccgatctacaagcagctggcagcctacggccacatgggccgcgaggagcttggcgtcaagtgggagaataccgataaggttgaggcgctgaaggcagcggtaaacgcataaatttagcgtgaagttataaaaaggcttcggaacattcgttccggagccttttttcgtgcagtaatggagaattgataatggaaaatggaaaatgaacgcgatgggtgaggtttaccgtatattcggtgttacggctgcaattcggaggggaaagggcgcggcgactcggcgcgccaaaacctatctgttctgcacaacataaatgaaaaaatggagaatggaaaatctacacattcattttccattctccattctcaattttcaattcatatctcgcgtgatctgcttgaatcgaatcaaaaacagcgttgtcgttgtagccgcggctaataaatccgcgaccggctctgcgaggaacacggcgaacagcttatccgcgaaaaagtgcggcaggactaaaataaacggtatcagcaggaaaaccttgcgctcgagcgcgagaaaaagcgagattttcgcctcgccgagcgccacaaacgactgctggaatccggtctggaacgcattggtaaatccgagcgcaaagtacacgcgcagcgcccagatggtgcgttcgaccagctcctcatccgaggtgaacaggtgcacgaccgtatgcgggaacagctgcacagctgcccagatcgaaaacgcgaacacgaacgccgccgcgagattcagctgcacgacgcgcttcatgcggtcgggccgcttcgcgccgcaggcgtagctgaggatgggctgcgcgccctgcgcgagtccggtcagcggcagctgcaccatctgcgccaccgaggtcaggatggtcattgcgccgaccgccgcgtcgccgccgtacctttgcagcgatacgttgaacgcaatggtgagcaggctttcggtggactgcatgacaaacggggacgcgcccagaccgactgcggatgccagaaccggtcggtcgatgcggaaatacgcgcgttttaagcgcagaaccgtctgctttccggtcagaaaccgcagaacccatgccgcagacaccgcctgcgagataattgtcgccacagccgcgccgcgcacgcccattttcagcacgaagatgaacagcgggtcaagcacggtgttgagcaccgcaccgatgacaacggttttcatcgcaaccgaggagcggccctgcgccgtgatgaagccgttcagaccgagcgatgtcatcacgaaaaccgtgccgagaacgtagaggttgaggtactgcatcgcatacggcagggtgtcggcagatgcgccgaacagtttcagtaatggcgcctgaaacagcaggaaaagtgctgtcagcacgagtgcaagcgcccagagcgccgccgtacacgttccgaggatgcgttctgcgcggtcgttctcctttgcgccgagcgcgatagacgcccgcggtgcgccgcccatgccgatgagcgccgcaaacgccgagatgagcgtgatgacagggaaggtgacgcccatgccggtcagcgccagcttgccctcgagcgggatgcgtccgatgtaaatacggtccacgatgctgtacagcaggttgacaacctgcgccgtgatggtcggcagcgccagccgaaagagcagcggccctacgggtgctgtgccgagggccgctgtctggttattctgttgttcactcatgccttgctgtcctcacggatgagcacgcggatggcctccacggcggcctttacgccgcgctcggtcgcgtcaggcggaatcgccggagcatcgtcgttgtccgcgttccacagcacgttgagcaccgcgccgcaccgcacatggagcacctgcgcgacgatcatgagcgcggctgtctccatctcgctggtgagcgcgcctgccgccttccatgccttccacttggcggtcagctcgtccgagattggcatctgcgcgggacggatctcgccgtaaaagctgtccttggactggattacgcccgtgtgatacgggaagccgagcgcctgcgccgcctcatgcagcgcggaaacaacagaaaaatccgcgactgccgggaactcgatggggaggtactcgcggctcgtgccctcctgccggatggcgccggtggcaatgacgatatcgccgccctttaccttgtccacaatgccgccggacgtgccgacacgaatgaacgtgtccgcgccgcactcgaccagctcctccatggcgatggcagccgacggaccgccgatgccggtcgagcataccgcaaccggaacgccgtccagagagcctgtccacagcgtgtactcgcggttgtgggcgatctgcttcgggtcgtcgaaatactgcgcgatcttctcgcaccgcgccgggtcgccgggcagaatgacgtaccgcccgatatcgcccttggtgatttgaatgtgcatctgtctgccgtctatcaacatacgatttcaccctcccgttctacggttctgatgtttttctctgccttgctgcgcggcagcatgacctcgtgcccgcagccgaggcatttcagcctgaaatccataccgatacgcagcacctgccactgcttgctgccgcacgggtgctgttttttcatggtaagaatgtcgtttacctgtatatccattgggttcacttcctttggtgggggcaataccgctatgcggtgttacccctattatccatagtgtatatgtaagactgttcagattcgctctaaaaggcacacgcagtgcgcggcaatgccctgcttggaaccggtaaagcccagtccctcctcggtggtcgccttgaccgaaacctgctcgaccgcgcagccgatggcggcggcaaggttctcgcgcatctgcagaatgtgcggcgcgagcttgggcgcctgtgcgagtacggtcgcatccagattgccgagctgccagccgctttcgcgcacgagcgcggcaacgtgccgcagcagcgcgatgctgtccgcgcccttgtagcgcgggtcggtatccggaaaatgcttgccgatgtcaccgagcgcgagcgcgccgagcagggaatccatgacggcgtgcgtgagcacatccgcgtccgagtgaccgtccagaccaagctcaaacggaatgttcacaccgccgatgatgcacggtctgccggagaccagtctgtgtacgtcgtaaccgtgtccgatgcgcatattacttgtcctcccttgtgaggagcgcttccgcaacgagaatgtcctccggcgtggtgatcttaatgttctggtagctgccgtgggtcgccttgacgatggtgccgagcgactcgacagccgcgcagtcatcggtgaagctgtagccgcgctcagcagccgaggtgagcgcacggcggagcaggtccttgcggaatacctgcggggtctgtactgcggcaagcgtgctgcgggcgacatcggcggcgatattgccatcctcgatgcgcttgatgctgtccttgaccggaacgaccggcgcggcagcgccgtactcggcggcggtggtaaccgcctcggtgataacggcctcggagacgagcgggcgggcgccgtcgtgtacggcaacgagcacggcgttttccggtgcggccgtgatgcccgcgagaacggattccgtgcgggtctcgccgccgcgcgttaccgtgcacagcttgtcaatggagaaggccttcgccagctcggtatagggcatgatgtcctgctcacggcagacgagcacgatatcgcggatggcggcgcatttctggaaggcggaaagcgtgcgtgcgaggacgggtacgccgtcaatctcgagcagcagcttgttttcgccgcccatgcggcgggaggagcctgccgctacgattacagcgcatacggcggggagatcagttttttttctgcgttttcccagcataattattcggtcctttctatcaaaaggctttgccgaacagcaaagccttacagttggtttgagcagcaacagcacaggctgtttgtatgcatctattttacacgctttcggcagcttttacaagaggaacgcgggtgggagagggtaacattgttgtcggtgcagccgattttaggtgttgcgcggcactgttatgccgcgcctgcgcagactaaaccgcctgtgtagcagtcaagtagccgaaatgcggaaaggtgttataccgcgcggaagaaaaaatcctctgccgttctccttttccgtgcttacgcagtctaccatctgcgcccaaggtaggcttacaagggaaaagggtgttcaaagagggtagaaaccgcaggtgtctaccctttttgccccctgccgtggatacggcaatttcgtaccgcgattgccgcactgacaaacgccatccacccgccgccgcctgctctccacaggaggacaccgcccgcaaggagaacgagaacggacacgcccgcaatcccgttcagcaggcgcgtaaaccgcccgtccgcgaggtgccggagcgccatgccgccgtcgagcgggggcacgggcagcaggttgaacagcccgagcagcgcactcgcgccggcaagccggtacgcgccgagcgggttcgccagtgcggtgagcgcaaagctggccgccggtccggcgaggcagatggcggcgcgcgaaaacggcgacggcggcaggctgcaccgcaggacagcgccgcaggcggtcaggcacagggcgtgcaccgagccgccggacagccgaatgacgaaaaggtgtccgcactcatgtacagccgccgccagcaggaaaatggggagcacgccgctctcatccgcgcaccagagcgcagccatgagcacaagaaagccgtcacggacctgaatccggctcacagcgtcagatagtcggcaggatcgagcgccgcgccgttgtgccacagctcgaggtgcaggtgcgggccggtggcattgccggtctgaccgaccttggcgatctgctcgccgcaggtcactttatcaccgactttggcggaaatgctgctgcagtgcgcgtataaggttgcaaaaccgtccgcgtgatcgacaatgatgtacaggccgtagccggattcgccggtctcgcgcaccgtgccgtccgcgaaggcggtgatgggcgtgccctcgtccgcggcaaggtcaagcccgtagtggaagcccggctgaccggtgatgggactgagcctgctgccgaaagaggacgtcagcgtgccggaagtcggcgtggcgtgctcgaactccagcggatagacggtctggtcaaccgtgtcgggaaacagggtctggtcgcggtctaaaatatcgtccgcaccgccggaggattccgcaggaacggtatctgcgggcatggcagcgccgccgaataccgcaagaacatggtcagcatttgccgcgccggacagggcagaagccgccttttcgcgcacggtctgcgcgaaggggatatcggcgtactttatcacaccggcagcgagaaccagcgttacgatgaataacagtccttttccgtggcgtttttcggtcatggggtaccctccttggtgctgtgaaaatggcataccgcagggtgcgacaattcaccttctgctctcaccccgccgtataaatggtttgcacacgcacaaccgtaggggcgaacattgttcgcccgcagcgcgaccagagcttgcgcaagaaacggccacgcacccatttaacggcggtgtgggagcacactgtgctcccctacgggatagcgatcgaaaatgaatttacaaacagtacgccgcgtcattacgtcaatccaatttatgaaaggggaagggcgcttatgcggttctcagcatgagaaaaattttgcggactctccctgcaaaaacggcggcaggatggaagtaatttgcaggaatccttgcggggcggacaagtgttcttgtgagaagatacaaaaaacgtaaagttactcaaaagataatcagtagattatctgaaattgtattctcagcacaaaaaaagtgcgccgaaatgcggaaatggtagtataatgtgaagcataatccaagacacccgataggatatgctgattcgggggaaacaaaggagaagatttcaccatgaagaaaacactcagtatgcttcttgccggcgctatgctggctacggcgctgaccggctgcggcggctccgcttcgagcagctccgattcgcagaacagcggctccgacagcaccgcttccggcgctgccttcaagattggcggcaccggcccgctgaccggcgcggctgctatttacggcaacgcctgcaagaacggcgcacagattgcggttgacgagatcaacgctgagggcggcgatattcagttcgagctgaactatcaggacgatgagcacgacgccgagaaggctgtcaacgcctacaacaccctgaaggactggggcatgcagctgtctctcggctccgtaacctccaagccgtgcgaggctaccgccgctgagaactacagcgaccgtattttcgcactgactccgtctgcttctaccgttgcggtaaccgcagataaggacaatgtgttccagatgtgcttcgttgacccgaaccagggcaccgcatccgcacagtacatcgcagagcagaagctcggcaccaagatcgctgtcatctggaagaacgatgacgtttactccaccggcattcacgacaagttcgttgcagaggcaaagaccaagggcctgcaggtcgtttccgacaacaccttcaccgatgcttccgctaacgacttctccgttcagctgaacgacgcaaagagcaagggcgctgacctggtattcctgccgatgtactatcagccggcatccctgatcctgacccaggcaaacgcaatgggctacgcaccgaagttcttcggcgtagacggcatggacggcatcctgaccatggaaggctttgatcccaagctggccgagggcgttatgctgctgaccccgttcaacgcagacgcaaccgacgaaaagaccgcttccttcgttaagaagtacaaggagcagttcggcgagaccccgaaccagttcgcagccgatgcttacgactgtgtttacgcttacaagcaggcactcgagaatgcaggcgctacgccggatatgtccgctgaggacctgtgcgacaagatgatcgagcagttcacctccatgacctttgacggcctgaccggcgagggcatgacctgggatgagaccggtgccgtatccaagtccccgaagggcatggttatcaagaacggcgcttacgttggtatgtaagacagaaccgtagggttccaacagcataaacgcaagggcgagtgaaggaggtctggaagcagtcctcctttaccgctattataaagaagataggaggcgcagtaattgagaatggaaaatggaaaatggaaaatgaatgagcgccgctgcgcggcggattaaatcatcgcgctatgcgcgatacctcgtcgtagcgcggacgaaactcgcgcaaggatagcgacattctcaattctccattttcaattttcaattacgctaactcgtatctattgttcctaattagaagaatggggtgttccaaaccatgagctttttgaatcatttgatcagcggcatcagtctgggcagcatctacgccatcatcgcactcggctacacgatggtttacggcattgcaaaaatgctgaacttcgcgcacggcgatgttatcatggtaggcggctacatgtgcttctgcgctaccacctatctcggctggccggcgtggatgggcgttgtgctggctgttattgtctgcaccgcgctcggtgttgttattgagagacttgcctacaagccgctgcgtatggcgccgtcgctggcggtgctgatcacggccatcggcgtttcgtactttctgcagaatgcggcgctgctgatctggtcctccaacccgaagacctttacctcggtcgttaccggcgaggcgctcagcctgttcggcggtcagatgcagatctccaaggtgacgctcgttgccatcgcggcgtgcgttgtcatcatggtcgctctgatgctgttcaccggcaagagcaaggtcggcacggcgatgcgtgcggtttctgaggacaagggcgcggcccagctgatgggcatcaatgtcaacacgaccatttccatcacctttgcgatcggctcgggtcttgccgctatcgcgggcgtgctgctgtgctccgcgtacccgaccctgatgccgaccaccggctctctgccgggcatcaaggcattcaccgctgccgtattcggcggcatcggctcgattccgggcgcgttcatcggcggcattctgctcggcatcatcgagatttttgccaaggcgtacatttccacgcagctgtcggacgcgatcgtgttcgcagtgctcatcgtggtgctgctggtcaagccggacggcctgctcggcaagcatgtgagcgaaaaggtttaagggggcagtcatatgaacaagttaaaatcctatgctgcgtctaagcgcggacgtgacacgctgctgtgcttcggcattgtcatcattgcgtacatcatcgtgcaggctgccatcgcaggcggcggcatctccagccagatcaagggtctgctcgtgcccatctgcgcgtatgttgtcatggcgatctcgctcaacctgaccgtcggcatcctcggtgagctgtcgctcggccatgcgggctttatgtcggtcggcgcgtttgcgggcattgtcaccaccacctgtctggcggatgcgattccgcttgcaccgctgcgtctggcggtcgccatggtcgttgccggactgtttgcggcgattgcgggtgtcatcgtcggcgtgccggtactgcgcctcaagggcgactacctcgccatcgtaaccctcgccttcggtgagatcatcaaaaacattgtaaacgttatgtatctcggtctggatgatgccggtctgcatttcagtctggtcaaccagaatttcgagctgggcgacggcggcaagatgatcatcaacggcccgatcggcgtatccggcgtcaccaagatctccaccttcacctcgggcgttgtgctcatcctcgttacgctgttcttcgtgctgaactttgtaaacagccgcacgggacgtgctgtcatggcggtccgcgacaacaagatcgccgctgactccatcggcatctccacctcgcactacaagctgctcgcgttcgtggtctccgcggcgttcgcaggcatggcgggcacgctgtacgcgatgaacttctccaccgtaaccgctgccaagtttgacttcaacacctccattctggtgctcgtattcgtcgttctcggcggtctgggcaacatctggggttccattattgccgcaacgctgctgacgctgctgcctgagctgctgcgcggcctgagcaactaccgtatgctcatctacgcaatcctgctgattgcaatgatgctgttcaacaactcctccttcaaggttcgcctgctggagaagcgcgcaatgcgtcagatggaaaaggccgaaaaggccggcggcaaaaaggagggtgcgtaagccatggcaatgctggaagttacttcgctcggcatttcgttcggcggtctgcgtgccgttgacgagctgagcatgaaaatcgaaaagggcggtctggtcggcctcatcggcccgaacggcgcaggcaagaccaccgcattcaatatgctgaccggcgtgtaccgcccgaccgacggcggcatccgtctggacggtcagaacctcatcggcaaaaagccgcatgaaatttgtaaactgggcgttgcccgcacgttccagaacatccgcctgttctcgcagctgagcgtgctggataacgtaaagaccggtctgcacaatcagatcacctactcgttcgcagagagcatgttccacctcggctcctaccgcaaaaaggagaagcagatggatgaaaaggcgctcgagctgctgcgcgtgttcgatctggacggtgtagccgactacaaggcggcaaacctgccgtacggcaagcagcgcaagctcgagatcgcgcgtgcgctcgctaccaaccccaagctgctgctgctcgacgagcctgccgcgggcatgaacccgaacgagaccgaggagctgatggagacgatcgaaatcgtccgcaagaggttcggcgtaaccgtcctgctcatcgagcatgacatgaagctggtctccggcatctgcgagtacctgtatgtgctcaacttcggccgtctgctggctgagggcacgcccaaggaagtgctgagcaatccggaagtcgttaaggcatatctgggcgaataagaaaggaggaaacaagtatggcaatgttggaagtaaaggacatcaacgtgtattacggcctgattcatgcactgcgtgatgtttccttcgaggtaaacgagggcgaggtcgtagcgctcatcggcgcgaacggcgcgggcaagaccaccacgctgcacacggtcacgggtctgctgccgtcgaagggcggcacggtgacgtttgagggcaaggacattacgcacaagccgggtcatgccatcgtgaagctgggcatgagccacgttccggagggccgccgcgtgttcgcgggtctgacggtcgcggagaacctgcgtatgggcgcgtatacccgcccgaagaatgagatcccggagtcgctgaaaatggtctacgagcgttttccgcgtctggaggagcgtaaaaatcaggcagccggtacgctgtccggcggcgagcagcagatgctcgcaatgggccgtgcgctgatgagcaagccgcgcatcctgctgctcgatgagccgtccatgggtctgtcgccgctgttcgtcggcgaaatcttcaagatcatcgaggaagtgtccaaggcaggcaccaccgtcctgctcgtagagcagaacgcaaagaaggcgctgtccatcgcggatagaggctacgtcctcgaaaccggtaagatcgtcaagaccggcaaggcagctgatctgctgaatgatgatgccatcaagaaggcttatctgggagaataaatttcggaaatggaaaatggagaatggaaaatggaaaatgaatgtgcggcgcacagcgccgatattaaataatcgcgctatgcgcgataccacaattctcaattctccattctcaattatcaatttatgtagggggtaaattatgaaaccttacgttattactatcgcgcgccagtacggttccggcggccgcacggtcggcaagatgctggcggacaagctgggcattccgttctacaaccgcgagatcatcactatggcgagtgaggacagcggtgtcaacgccatgctgttctcggacgagcgtctcaagggcgatttcctgacgcgcctgcgcgcgcattatcacggcaacgcgcccgtaccgaacgactcgtccaagtcctacctcaaggatgaggcgctgttcgcctatcaggtgaagatcatccgccggctggcggatcagggtccgtgcgttatgatcggccgctgtgccgactatattctggcaggccgaccggatgttgtgcgcgtgttcgtccatgcggacaaggctttctgtctcgagcaggctatgaaggtggactcgctgccggagcaggaggtcgagaagaagatcgcggagatcgacgattaccgcgcccgctactacaagcaccacaccggccacgactggtatgacgcgcggaattatgatctgtcgctcaacagcggcgtgctcggctttgacggcaccgttgaagagatcatcaagtatatggaagtgcgcgagcagtttcagaagtaaataggggagaaccgtctgtgagagcaggcggttttctttttgtccattcccgcaaatgctgcacgcgcgtacaataatgattgcaatatcccgtagggtgcgccgaggtcggcgcaccgcatgtaaattcatttttgacggatatcccgtaggggagcacagtgtgctcccacgccactgttcaatgggcgcgtgtgaatggtaaatccgccgatggttcacacgcacggacgcaacggtaacgtctgttgtgggcgaacactgttcgcccctacgggataacgtgtacagaccggatagcaacggtaaaccatggcaggaaaacggtgcagattcgacccgaaaaaactttttcaaaaaaattttgaaaaaagggttgacgaaacggggattctgttatatactaaacaagtcgtcagcgatgagtcatcaaaaacgacaacaacttaacaagatggagagttggctgagtggtcgaaggcgcacgattggaaatcgtgtaggcgtgatgagcgtctctagggttcaaatccctaactctccgccataaagagctgaaactttagtttcagctctttttgcatttgtgagaacgtcctgcggataaccgcgggatttttttatttcccgaaaaatattttgaaaaagttttttcggagttgaccatttgtggtcaattttttatccgttccggcggtagggtaaagggaggtgctcacatgggcagaaacagaaaagttggattggactggtggccgcgcgacatcggcctgtaccgtgacccgaagctgagagccgtacggcagaaattcggcgtgctcgggccgtatgtgtacgaatgcctgctcgacattgcctacggcgacaagggctactacatcgcctacagcggcgagggccgcgaggacacgctgtggcagctccgcgagtacaccgccggactggaaaacgtgacgatcgaaacactggccgccgtagtcgatcagctggtggcaagcggcctgttccatgctgcgttatatgaacgcggctttctcacatccaaaagaatacagatggggtatttcatcgcaaccttaggacgaaatgcccagcagatcaactttgacatttggctgctctccgaggacgaaatgagggagaaaaacccaagtggcaaggcttttattctgcgctcctttatttctcgccaagaaaagggcatttctcgccaggaaatcggtatttctcgccaagaaagtacacagagcagagaagagcagagaacagaagagcagaggacagtagaggacagtagagcagagcagaccagagaagagaaagcagttacggctgattctggtctgacgaccgaactggaagaaaaactgaattgtaagtttgaccataatttctgtctggagctgcgcaggctgcagaacaagggaatgcaccgtgaggtgttcttagataccgcccgacagacggctgagaatgcaccgcgcaatccggcagggtatttccgcacgctgctgcagaactgcgagcgtgacggcattctcaccgctgaggatatgcagaaacgggcaaagcccgcaccggcgcaacctgcaatcgggccgtcgagcgaacagctgtccgcgttcgatcaggaatggtacgagcgggtcaagcggtacacaagggaaaaggcagtgccgtcataacccttttcaaccgcgcccgtgtctgctataatgagacagacaagagaggtgattaggatgggctacattcgccgtcctgcgtattacaaggcattccggtgcatcggctcggactgcacggaaaactgctgtatcggctgggagatcgacgtagacgaggattcccttgcgtactacgagaccgttcccggcgattttggtgagcgtttgcgcgcgagcattgcgcctgcggacgcgcagaccggagagccggcgcattttcgtctggacgccgaggagcggtgtccgctgctgaacgactgcaacctgtgcgaagtgctgcttcacttaggtgaggacaaaatggcgcagatctgcaccgaccacccgcggtattacgagtggttttcggacggccgcgaggacggtctcggcttgtgctgtgaggctgccgccgagttgatactcgcgcagaccggcgcaccggcgtttgacgtgaccgaggcggacggcgtatccgaaaccggcacggaggccgaaaccgaactggagaacgtactgttttccatgcgcgatgcgctgttccggctggcgtgcgaggacgcgccgttcgatgacaaggccgacaggctctaccgcacggcaaaggcgcagcaggagcagtacgacgacctgctgttcccgttccccgagggggaggacgaggatgcagacgagacggacgaggacacggcttcgtggtcgcaggcgttctggcgggagagcacgctcacgagcctgctcgagctgctgctcggctttgagatcaacaaggacgactggcgcacgctgctgaccggcgcaaaggcgcgtctgccggagattatcgcccgcaggaatgactttttgcaggcgtatcagggcaaacgccatgaatacgataacctgctgacgtacttcctgtaccggcactttatgaaggcgctcggggacgacgccgtgcaggacaaggtgcagctggcgctcgtgagtacggcggtcattcagctgctcgatgtgtacgagtggctcgtcaagggcgaggtcacgcactgggcgcagatctgcatctgcaaggcgtactcgcgcgagattgagtataacgaggacaataccgagcagcttgccgcgttttccgtccttgacgaaatggaataaaaccgaacaccgcggactgggggtctgcggtgtttttgttttgcggtggtaacgccgtacccacggcggtgggggattcgcccctgacgggcggcagctttttcagcaccggctgagcgggggacgcgaactgccgcaagcgtgttcgcccctgacgggcggcagccttttttcagcaccggctgagcgggggacttgaaccgcgcaggcggttcaccctatccgggcggcaggtttttcgctgaggttcagcgagggagttgcgctctgcggagcgcgggagactgccgcgcccacggcggggggaacgtcgcggcacccgccgcagggggcaaaaaggaagggacacctgcggtttcccttcctctttgaactcctacctttcccttgcttcctaatccggcgcagatttcctatatgtgaccgcttcgaaaaggggaacggcagaggattttttctctgctacggacgaactaccttcggagtccgtcctcttgagcaacctgttcgcagtgtcagatacattactgctacacatgtgatttcatctaagcaggcgcggcatgacagtgccgcgcaactcgttagtctggagtttacggacggcacctgcgaattaggcgtttggtacaatttatcttcgtaggccctgtctataacaacgcgctaacgaatcgtgcggcactgttatgccgcacccagcgtagagttgcccgtatgtgtagcagtacgctgtctgtgaattgcgaatatttcacgaaagacacgctgaagtaacccgactgccgtaccccttatttcgcagcggtcacatgtcggcaatctgcgccagactatctaagggaaaggtaggagtccaaagaggaaggaaaaccgcaggttgtccttcctttttgccccccgccgtgggtacggcgaatcccccccgccgtgggtacggcgaatcccccccgccgtgggtacggcgctcccttgtgtaaagtttgtgtaaagcgggtgcaccttttgtgatactgccgaaaatccgctgaacgccttcgcatttacagacagaagcaaaaatgaaagggctttcacccaatccgaaggaggcgttctccatgagtgaatatcaaggcacattcaagcgatatgagaagaaatatctggtcacgcagcagcagtacaacgcacttgccaaggtgtttgcggcgcggatggtgcccgatcggttcgcggaatcgaccatcagcaacatctattacgacacgccggatttccggctcatccgccgctcgctcgaccgtccggcgtacaaggagaagctgcgcctgcgtacctaccgcacgccgcatgccgacaccgaggcgtttgtggagattaagaaaaaatacgaccacatcgtctacaagcgccgcgttgcgatgacctacagcgaagcgcaggcgtatttagacggcggcgcggcacccgagcagagccagatttcccgcgagatcgactggtttctgcacttctacaagggcattcagcctgccatgtgcatctgctacgaccggctcgcgctgttcgacaagtatcagccggaactgcgcgtcacgttcgactcgggcatccggtggcgcatggacgatttagacctgtcctccggctcggcaggcgagcagctgctgccgcacgacacctgcctgatggagataaagatcccgggcacaacgcccctgtggctggcgcgggtgctgagcgagaacgctgttttcccgacccacttttccaaatacggcgcggcgtaccagaccatactgcgcgagggtcgttcgccgcagttcggcagcgaaaccatccacctcaacgaaaaaggagaaatttactgtgcttgagacaattttcggttcgattctgaccgccggcctgaccggcagcgcgttcgttatctgtttgctggtggcgcttgcgctcggcgcactcgttgccgccgtttatatgtacaaaaacacctacacgcagtccatggcggtcacgctggcgctgctgcccgcaatggtgcaggttatcattctgctcgtgaacggcaacctcggcgcaggcgtggctgtctccggcgcgttcagccttgtgcgattccgctccgcggccggctctgcgcgtgatattacctgcattttcctcgccatgacgctcggccttgccaccggcatggggtatatcggcattgccattgtcaccggcgcggtgatgtgcagcctgctgaccgcctacgcggcgctgtccttcggcagaaagccggaggaggagaaggagctgaaaatcaccattccggagaacctcgactacaccggcctgtttgacgatctgtttggggagtatacccgctcggcagagctgatttccgtgcgtaccaccggcatgggcagcctgtataatctgcattatcatgtaagacttgtgtctcccgagattgagaagcagtttttggacgctatccggtgccggaacggcaacctcgatatcgtttgcggcaaggtgccgcaggtgaaggaagctttgtaatggaaaatggagaatggagaatggagaatgaatgtgcggcgcgcagcgccgatattaaaataatcgcgcaaggcgcgataccacaattttcaattttccattctcaattctcaatttgcttgatgaaaggatagatttatatgtatacgaaaaagaaactcctcgccgctttgctgacctccgcgcttgcggcgggcatgctgccgacatcggcgtgcgcggcctccacgtcctacacgacctcgaatgccacgcttatccgttttaccgatgccgccgccaaggcttcgggcaagtacaccggctatgagattgacggcaccgacgtttctatcacggcggcgggcacctatgtgttctccggcgactgcgataacggctcgatcacggtcaaaaagggcgtcacgggcgttaccattgtgctgaacggtctgacgcttaccaatgacgacagcgcggcgatcaccctgaacaagaccgccgaggcgtccctgattgcggcggcgggcacgaccaacacggttgccgacaccgaaggctcgagcgacgagaacgcggcggtcaaggtcaagagcggcgccgcgctcgccatcggcggaacgggcacgctgaccgttgacggcaacgcgaaaaacggcatcaagggtgcggctgacgcggtgattacggttgcggaggtcaagctgagcatcaatgccgccgatgacggcctgtcctgcgacgatgagctgaatattaccggcggcacgctgagcatcacggcgggcggcgatgcggtcaaggcgtctccggacacaggcgacaccgagaacccggacacgacctcgctcggcaatgtgaccatctcgggcggcacgctgacgctgaacgcgaccggggacggcgtgcaggcggacggcgatttgacgatttcgggcggcacgtttcacgtcaagacgaacggcggccacacgaccgcgctcacggacgattccgcctcctgcaagggctttaaggcgggcaagaccctgactgtcaccggcggcacgctgaccgtggacagcgcggacgatgcgctgcacgcgaacgcggatgtgagcatcacgggcggcacgctgacactggcggccggtgacgatgccgttcacgcggacaacgaccttgtgatcggcaccaagggtgcgtcctcgacgagtacgccgcgcatcaacatcaccgcaagctatgagggtctggagggcacgaccgttaccgtgtacagcggcgatattgatgtggcagcgtccgacgacggcgtaaatgccgccagcagcacgctcggtgagcgcagcgacaaatacgccatcaacattgcgggcggcgacctgtacattgacgcaggctcggacggtctggactccaacaacgatatcagtatgaccggcggcaaggtcgaagtctacggcgcggatgccatgatggacgcggcgattgattatgacggcacgttcacgctgtccggcggtacgttgttcggcgcgggcatggagccgagcgccggtacgcaggcgtatatcgcggtcggtgagacctcgccgtccggcggcggcatgggcggcggcccgaacggacagggcggcggtcagggcatgaccccgccgggtgacgcaaacggcacgaacggcaatcgtccgaccccgccgaatttctccggcaatacctcgaccgacggcacgtttacgccgccgaccaagccctccggcggcaaggcggacggcaagctgtccggcaatctgccgaaccgcgagagcgccctcggcatcaaggagggtagcgtcatcaccgtgcaggattcctccggcaagaccctctgcaccgcgaccgcgctcggctcgatgagcagtgtgatcttttcctcggcggatatcaaggagggcgagacgtacacggttctggtggacggtacctcggtcggcacggcagagggaaagctgggtaccactgattcaagcagctcgatgagcacgtttaagccgggtcagggcggtcagccgaaccagaacggcagtcaggccacggtcggcagtttcaaggatgtgccgcagaacagctggtttgcaagtgcggtgcagtacgtcacgagcaacagcctgatgaacggcacgagcacgaccgccttctcaccgagcgcgaccatgagccgcggaatgctgatgaccgtattggcgcgttatgccggtgaatcgacagagggcggcacggtttggtatgaaaagggcatgaactgggcgaagaacaagggcatatccgatggctctgcgccgaaccgggatatcacccgtgagcagcttgccgccatgctgtaccgctatgccggtgagccggacggcgcggcagacctgtccgcctacgcggacgcaggctcggtttccgcgtatgcggaaaaggcggtgcagtggtgcgtcaagaacggtatcctgaccggtaaaacgtcctcgacactcgctcccaaggctacggctacccgcgcggagtgcgcggcgatgctgcagagatttgcttctctcaccaagtaaaagaaagagcaccgcagaatacaggctgcggtgctttattttgtaaaaagttgatatttgtatggactcagcccattcgcgcgatagcgcgtattaaattaggattgctctgcaatccgaaaaaaccgggagcatgtatctcggttttttcacttctggagggagaaagtttctgtataggaactttcggacgactttggaacggcccacggtccgttcctgcttgtcggcgaaactgtagtttcgcgacagcctcagcaccgcagaatgcaaactgcggtgctcttttttgtccttcaaaacatacggaagtctacgcagaacggtaacagtcggtacaccgtttcaacacagagcaaaattatgatagtatcatccaaggaaaggaggcggcggcatgcagacgagcacacaggcagtccgcgcacgcacggacgagccgtttttggagcggttcattgaggcacatgaggcatttgttctccggtgcgcgagcaggcatgcaggctttgcggtcacgcgcagcgacgatgaatattcggtcgcgctgctggccttctacgaagccatcaagggctacgacccggcaagcgggccgttcggcgcgtatgcgtcgcttgtgattggcagacgccttgccgaccattaccgcagtcagcaccggtttgacgcggaaacaccgcttgccccgcagacgttcgacggcacggtggaccgcgagagcgcggacgccgccatgcagcaggcggtcgcggagcagatgagcgaagcaaagccggtcagcgcacaggaggagatcgaggcggcaaacacggtgtttgagaagtatgggttcgcgttttatgatttagcggcaagctcgcccaagtcggacaagacgcgccgcagctgcgccgcggcggtcggcacgctgctgcattcgccggtgctgttcgcgtccatgcagagcgcgcacagcctgcccatcaaggcgctcgcgcaacagtgcggcgtgtccgcgcggacgataacccgtcaccgggattacattgtagcggcggcgctgctcatcgacggcgattaccccatcctctgcacctatctgcagaccatgcgcaaggaggcagagcaatgcgtgcgataattacggatattcgagcgggaaaggccgccgcgctcgcggaggacggcacggttcgccttgtagacgcgaagaacagagcggtcggacaggagattcggattccggcgaagcgccgcagacggtggaaaaagccgctgacctgggcggcgtgcgtggctgtcctgtgcggcatggcgaccaccggcgtgtacgccgcgtatgagccgtatgccagcgtcagcgtcgtgggcggcacggacagcgtggagtatacggtaaaccggttcaatcaggtgctcggcacccgcgtttccggcagggagcagccgccggacagcaaaattccgcggtttgtacacattgataaggcggtggagcataccgtccggcaggaagcaaaggaaggcgagagcgtcagcatcaccgtgacttcgcgcagcagcggccacgccgaacggctccgcgagcatattgacgatcggtttcggcagtccggcgatgagagaaacccgcctgaggtgagggtgcagccgccgcaggacacgggtaacgcgccggaagagagccggcagagtgaaagcgcagagcaggcataaaaatgctcccgcgcttgacttggcgcgggagtgtggtataataaagatacaaaagggaaacgctgttgtacagcggtcagaccttacaacagatcaaggtttttagacgatgaccgtttggggtacgagccaagcggtcatcgcgcatttacgagaaaaatgtacagtacaatgaccgcacagataaaaagctcgaaggctttcttcctcatgcgcagcacctccttccgcccacagactgtggggaagaagagggtctgaccgcctgcagtgattgctcactgcgagtgcaacagcgtttccgtgtattcagtataacaggacgtgcgaaaaatgtcaatttccgcaggttgacagtgcctgaaagtgtggtataataaagatacaaaaagggaaacgctgtgtacagcggtcagcccttacaactaatcaccatgttttaagacgatgaccgtttggaggctacccaagcggtcatcgcgcatttacgagaaaaatgtacagtacaatgaccgcacagataaaaagctcgaaggctttcttcctcatgcgcagcacctccttccgcccacagaccgtggggaagaagagggtctgaccgcctacagtgattgctcactgcgtgtgcaacagcgtttccgtaaactaagtatatcacacaggcgcaaaacctgtcaatttgcggctgaccttacccggtcagccgctttttgtgtgaaaatgcttgccttttgcatggaaaatgccgtatacttgtatataccgaatccacacgctaaggagcgaaacctatgaatatcaccaagggcgatgtgcaggagctgcgccgccgtttgaaaaagaccgaatgcacgttcgggcgtctgtgcggctgctacgtcaacagcggcaagcagatcgtgaccaagttcaccgagcagttttccgaactggaagaggatgaatactacaagtacctcgagattgcgaaaaagacgttcagcggcacgctcggcgcaaatctgctggaactggagtttgaccgcagcgacagcggcatcgagcaccagaaatacctgctgacgctcaaggacagcaagctggcgaacgaggagctgctcgaccgcctgtacgagcaggtgatcgaggagtacagctacccgggcaactacctgatcgtggtttaccacgatgtgtacgacgtgccgagcaaggccacctcgggcgaggaccaggacgaatccaccgagctgtatgcgtactgcgtgtgcgcggtctgtccggtcgagctggcgaagcctgcgctcggctataaggaggacgaaaaccgcatcggtgcgcgggagcgcgactgggttgtcggtctgcccgacctcggctttgtgtacccggcgtttgcaaaccgcggcagcgatgtcaacgccgtgatgtactacgtcaagaccggccgtccctctcatccggagttcatcgagaacgtgctcggctgtgtcgcgcagcgcacggctgccgaggacaagctggcgttcaagaacgtggtgcacgatgcgttcggtgaggatgaggagcaggcggacgcggcgttcttccagatgcagaagaccatcagcgccatggtagccgagcgggaggaggacgagagcctgccgccggtcgagctgaccgccgaggcggtctccggtctggcgaccgaggccgaggtgccggatgaggtgcgcgcgcagatcgagaagtcgtacgagcaggtgttcggcgaccagccgccgcaggcgcataacgtgctggacagccgtctggtcgaggagggcacggtcaaggcgcataccgccgccctggagcagaaggtggcagtgctgcagcaggagctggcacatcaggcggcaaacgccgccgacacggacgaggacgacgttccgtgggagaccggcacggtcattgacgttcgcatgccgcaggagagagccgtaaacgtccataccgaggttgtggaagggcagaagtgccttgtcattccgctcaccggggatgaatccgcgcggatcaacggcgtggaagtggaataatggagaattgaaaatggagaatggagaatgaatgcagaggtttcattctccattttttcatttatatggcacatatacgatgtttttgattgtgcagcatacgttttatcatttgcacaatatataccgtagggtgcgccgacctcggcgcaccgcatccaacgattaccaccatgttatatgatatgggcaaccgttatggataacacattccaacgattggtacaaaccacaccgtaggggcgaacattgttcgcccctacggttatgcgtctgcatatgaatttacatacggtgcgccggggtcgtcgcaccctacacgatatattgtgcaatagattatattcgcatatgccgcgcctgcgtagagttgcccatatgtgtagcagtacgctgtctgtgaactgcgaaaaggtgaagaaagacacgctgcggtaacccgactgccgtactccttttcgaagcggtcacatgtaggcaatctgcgccggattaggaagcaagggaaaggtaggagttcaaagaggaaggaaaaccgcaggtgtcccttcctttttgcccccgccgcggggcgcggcacgttcccgccgtccgcagacggcgaatccccccgctgaggttcagcgaaaaactctccgcccggaaagggcgaacacgctgacgcagttcgcgccccccggctttccggtgcagaaaaggagccgcccgttaggggcgaacacgcctgcggcagttcgcgcgccccgctcagccggtgcagaaaatccgggaaatcccgaaaaaattttcccgcccgaaaaggcagcaaaaacgcccgttctcacgctgagaaaacgtctatccgaacggtgtagttagcaaaacctaaccacccggaattcagccgaaaatttctctcgaaaaagtgcttgacatattggttaggatatgctaacttatatacatggttagccgaggcttactgatacgccccgttgaccggcacgcttcctcacggaacgggaacgtgctgaaaagttataaaagaaacagcttcctctgtattttgcgcatcattccgaacaaaaccgtataggcaataccgcataattgaacaagagcggtttgcggcggattttgcgcactgatgaggcgtggttttgcagcaatacttgacgtattgcaaaaaatcacaacgaaatcagggcacaaaagacccgcaaaacgccgcagctttaattgtgcggtattgcctcagggcctgcgcggctgaatggctaaccgcagccgcgctgttcgggaaaaccgcataccaaacgtacagaccggaaatactgtaaacgggaggtgcatcagcaatgcaaaatggcttggatcgacttttagcaacctactgctcgccgacactggcgggcatcaaaccggcaagtctggtgtcgtgcgaccggaatttatatcccgatctgccgcagcggctcagcgaataccgcaatgctttcgcagcgcgagaaattcactttgagatcgtctgcgcctgcagcgcacgcttcctcttactggtatacagcaagccgcagcttgaacgccgcatggcggacccgcaggtgcagcatgtgctccggcactttgcgtacccggtcggtcagccgctcgacgtactgctgcgcaatctcaagcgccgcatcgccatgtccaaggactttccgcacgagatcggactgttcctcggatacccgatcgaggacgttgtgggctttattcgatacgccggaaagggctgcaaattaagcggtctctggaaggtgtacggcgatgccgaagcggcatcccggctgtttgaccgcctatcgcgggtatgccacgccgtgaccagacgcgttgacaagggcgaaacccttctcgaagtgtttgcagcatagcataactcgatagaactacaaatatagaacaatacatgcgaaggagcaaaattatcatgagcaaagcagcagttattttctggagccagaccggcaacaccgagcagatggcaaacgcaatcgcagacggcatccgcgagggcggcatggaagttgacgtactgaacgttgcggacaccaccccggctgacgctgttaagtacgcaaagattgctctcggctgcccggcaatgggcgctgaggttctcgaggagaccgagtttgacccgttcttcaccgaactcgagagcaagatttccggcctgaaggttgcgctgttcggctcctacggctggggcgacggccagtggatgcgtgactgggtacagcgtaccaacgacgcaaacgctgtcatctacaccgatgagggcctcatcatcaacgaaaccccggatgaggacggcatcgcaaagtgcaaggagttcggcaagggcttcgcagcattctaaattagattttctcttgcggcgtgtgcatacctgcgcacagcgccgaaacaatttctcacggtcgtaaccgatacgacggtaccggttatgatacaaatatcctttcttgtcccgggggaaaccccatggcatactgcccggtatgtcaaaacataacatgagcccgcggtcatccggaacaatggccgcgggcttcctcctatctgcaggatgccacagttagcgacagcatactgcacaattagccgcggcaaactctgtacagattggttagcttcgacaaacttttttttctgtcttgacaacaaaaggttagctggtgtaaacttcaaatgataaataggttagagcggtctaacctgatacaaaacactttttttcgcgcagagattacagaaaaggagaggattaccattatgccgcttacgttaatggatgttggtgtagagaccaccgtaaagaccattcgaggaaaagaccagacgagaaagttcctgcagaatctcggctttgtcgagggcgcaaaggtcactgttgtgtcttctctggcaggcaacgtgatcgtaaacgtgaaggatgcgcgcgtcgcaatctccgagcagatggcttcgcgcattatggtttaattgcaaagggggcaaacgcaaatgagcaatctgagacacacgccggtcggcgccaccgtaaccgtccgcaagattgagggcgagggtgcgacccgccgccgcatcatggatatgggtatcacccgcggtgcggagatctatgtccgcaaggtagcgccgctgggcgatccggttgagatcaccgtgcgcggctacgagctgtcgcttcgcaaggcagatgctgagatgattcaggtagactgatttcgattgaaaccacagtttcaatcgagggctgacgaaaaaccgcgccctttgggcacattgcggcagacgaaaattcgttaaaattttttttacataggggttagcggatactaatcccaagaaaggggaaaaaacatgtcaattcgtttggcacttgccggcaacccgaactgcggcaagaccacgatgtttaacgatctgaccggtgcgacccagtatgtcggcaactggccgggcgttaccgtggaaaagaaggaaggcaagttcaagggcgacaaggaagtcctgatcaccgacctgccgggtatttactccctctctccgtacacgctggaggaggtcgttgcgcgtgattacctcgtaaacgagaagccgcaggccatcatgaatctggtggacgcttccaatatcgagcgcaacctgtacctgaccacccagctgctcgagatgggcattccggtcgttatcgcgctgaacatgatggatatcgtcaagaagcgcggcgacgtgatcgacgtaaagaagctgtcgcaggagcttggcgtgccggtcgttgagaccgcagccatcaagggcgagggcaccaaggagctggtcgaggccgcaaaaaaggctgccaaggcaggcaatgcacccgcaaagcgtgcgttcgagggtaccatcgagaacgccgtcaccgagatcgagaagctgattgcggatgttaccgagccggcgcagcgccgctggttcgctgtcaagctgttcgagcgcgacagcaaggtgcaggcgcgcttcaccctcggcaaggacgtgcaggacaagatcgagaagctcatcaccgccgttgaggaggagctggacgacgatgccgagtccatcatcaccgatgcgcgctatcagtacatcggaaagctggtcaaggactgcgtaaagaagaaaaagaccggtctgtctacctcggataagatcgaccacatcgttaccaaccgaatcctcgctctgccgatcttcgcactggttatgtggctggtctactacgtttccgtatccaccgcgggcggcatcttcaccgactgggcgaacgacggtgtgttcggtgacggctggcatctgttcaccatcggcgctgctgactatgaggaagcaaccgccgagtacgacgaccagatcacccgccgcgacgcatggctcgaggctgccgacgaggccggcatcgacaccgctgcgctgaccgagcagctcgaggccgaggaggctgacgaaaccgctatcgctgacgcagctgctgccatcgaggcagacccggctgccgcatcggttgtcggcactgccgagttcgaggacgaggactccggtgaagtcaccaccgaggacgttgacctcgcaggctttgaacaaaccctgaccgctgcggagccggacccggctgacttcggtgtatgggttccgggtatcccggtgctgctggagaagctgttcgcctccatgggcgttaacgaggacggctgggtttacagcctggtaatggacggtatcgttgccggtgtcggcgcggtgctgggcttcgttccgcagatgctcatcctgttcttcttcctcgctatcctcgaggactgcggctacatggcgcgtgttgcgttcatcatggaccgtatcttccgcaagttcggcctttcgggcaagtcctttatcccgatgctgatcggctccggctgcggcgtaccggctgtcatggcttcccgtaccatcgagcaggagcgcgaccgccgtatgaccatcatgaccacctgcttcataccgtgcggcgctaagctgccgatcatcgcaatgttcgcaggcgcgttctttggcggctccggcaccatcgcattctccgcttatgttctgggcgtactgtccatcatcatctcgggcatcatgctcaagaagttcaagatcttcaccggcgacccggctccgttcgtcatggagctgccgagctatcacgttccgaccgccggcaacgtattccgctccatgtgggagcgcggctcctccttcatcaagaaggcaggcaccgttatcctgctgtccaccatctttatgtggtttaccctcggctacggctgggagagcggcgcattctgcgcggttaccgatattgacaactccatcatggcgcgtatcggctctgttatcgctccgatcttcacgctgccgggcttcggtacatggaaatccgccgttgccgccatctccggtctggtcgcaaaggagaacgttgttgctaccttcggtcagctgtatcacttcgtcggcgaggttggagagaacggctccgagatctggggcgagctggctgcggactttacgcaggtcggcgcgtatgccttcatggcgttcaacctgctgtgcgcaccgtgcttcgcggcaatgggtgccatcaagcgtgagatgaacaacggcaagtggactgcactggccatcggctatatgtgtgcttacgcttacgttgtatctaccatcatttatcagatcggcggtctgatcaccggcgagctgagcttcggtgtcggcacggtcgttgccatcgcgttcatcgcgctgatcatcttcctgctgttccgcaagccggccaaggctgactccaccgagggcctgcgccgcatgagcgttgacgccaactgatttctttcggatttgaaaagaggctttaaccatgagtattggtgatatcattctggcattgatcgtagtggctgtcgtgttcttcgcggtccgttcggtcttcgtcaagaagtccgtcggctgcagcggcgactgcgcccactgcggcggcagctgtcatcatagtacgcctccgcaaaagaagaaataacacctctctaaaccgttcggcactccggtgccggacggttttttgcgttaagatcgtactctcggacagggattcgcaggcagagcttttgtggtgtgcccgaaccgcgcaggcggttcgccgattctgggcaaggattccgccgctgcggcggcgggagcgtttgccgtacccacggcagagggcaaaaagggtagacacctacggtttctaccctctttgaacacccgtttcccttgtaatcatagcttgggtgcagatggtagactgcgtaagcaggaaaaggacgcggcagtcgggttactcttgcgtgactttcgcaaacctttcgcagttctcggatagcgtactgctacacatgcgggttaatcaacgcagagtgcggcataaccgtgccgcacaattcgtcagcgcgttatgatggacagggcctgcgaggataaatgctactaaatagatagattcgtaggtgctgtccgtaacctccagactaacgaattgcgcaacacgggtatgttgcgcctgctggaagtagccgacctgtgtagcagaacggtatctgacactgcgaataggttgagaaagacatggaagaaaaaatcctctgccgtattccttttcctgcttacgcagtctaccatttgcacccaagccctcgaaggaaaggtaggagttcaaagaggaagggaaaccatgggtgtcccttcctttttgctcccgcggcgagtgccgcagtccccgcgccggacggcgcaatgtccccgtcgtggttcacggcgaaatccccgcccggaaatggcgaaccgcctgcgcggttcgggcacaccgcaaagccggtgcctgcgaccgcttcgctatcctcgaaaacgccctttgcctttcccactcggcgtgctataattgatacataaaggtggcgaacgcgcgtgaaacagctgaccaagaaccaactgaagatttttgcgatcgtgtgcatgacgctcgaccacatcggcgcactgcagatgggcttgaagccgcggcaggataaccgctcgaacagtggaagtacagcggaaattgtggtataatagcctcattcggctattataaatgattgaatggcgtataccaccagtggcataaaaatttacgttaaacttaacgtttagcagccactgtggtatactatatataatgtatcaatgagcgaggaaaatacacatgaaaatcatggtgatagacggcaacagcatattgaaccgcgcgttctacggcatacggcagctgaccaaccacgagggactgcccaccaacgcggtttacggctttctggctacgctgttcaaactgcaggacgaggagcagcccgaccgcaccatcgtctgctttgacgtgaaggaaaaaaccttccgccacctcaaattcgacacctacaaggccacccgcaagggcatgccggatgagcttgcagcgcagctgccgattacaaagcaggtgctcgatgccctcggcgtaacgcgctgcgaaaaggcgggctacgaggcggatgacctgctcggcaccatcagccgccgcgcggacgagcacggcgacacctgcgtggtcgtaaccggtgaccgcgacagcctgcagcttgtcggcggcggcacgaccgttatgctggtctccacccgcatgggacagaccacctatcagacctacgacaccgccgccttccgcgagaaatacggcttcgacccgattcgcctgattgacctcaaggcgctcatgggcgattcgtcggacaatatcccgggcgtgcccggcatcggtgaaaagaccgccatgcagctgctgcacgacttcggcacgctcgagggcgtgtacgcgaacatcgacgacgagcgcatcaaaaagggtgcgcgcaccaagctgcagaacggcgagcagtccgcgaaggacagcttctggctggcgactatcgaccgcaatgtgccgctcgacctcgatgtggagcacctgcctgcgcaggatattgacgagaccgcgctctacgacctgctgacccggctggagtttaagaatttcatcaagcggtttgacctttcgggcgagagcgtgtccgcgccgcgtctgccagagctgaaaacagaacgagcccagaatgtgctcgaagcgttcaacttaatggattcgctgaccgactgcgaccgcgtgtacgccatcgtgccggaaaccttaggcgcagtttgcctgctggacggcgacacggcgcacatcctgtttgcggaggcgttcggtgacgcgtggaacgacattctgtgccgcctgttcgacggcacgctgtccctcgtgctgcacgatgcgaaggccaccgtgcgggcactgctgcagcgcggtatggacccgaagggcatcgtgtttgacaccgccatcgcggcgtatctgctcgacccgacccagtccggctacgacctgccgcggctcgcgcttgcgtactgcaatgccgagctgccggagctggatttggacgatccggcagcggtttcactcctcggcggtcaggaggacacagagaaggccgtggcgcagcatgtcggtgcgctgcgcgccatttacgccgaggcggctgaccggatcgagcagttcggcatgagaaagctgtactacgaaatcgagctgccgctcctgcgcgtgctggctgagatggaagcggcgggctgtgcggtcgagccggacgagctgcgtgccttcggtaacaagctggacgtgcgtatccgcgacctgaccgagcagatttatcatgacgcggacggcgagttcaacatcaacagtccgaagcagttgggtgaggtgctgttcgagaaactcggcctgcatgctccgaaaaagaccaaaacaggttattccaccaacgttgaggtgcttgagcgtatcgcggaggaccacccgatcgtgccgcgcatcctcgagtaccgcaagctgaccaagctgaaaagcacctacgttgagggacttctcaaggtcatcagtccggtggacggacgcattcacacgcattttcagcagaccgtgaccgccaccggacgcctgtcctcgaccgacccgaacctgcagaatattccggtccgcaccgagcttggccgcgaactgcgccgcatgtttgtcgcaccggacgaaaatcacgtcctgatcgacgcggattattcgcagattgagctgcgcgtgctcgcgcatatctcacaggacgagcacatgatcgaagccttcaagcacgggcaggatattcacgctgcgacggctgccaaggtctaccatgtgccgcttgaggaggtcacgccgcagatgcgctcctcgtgcaaggcggtcaacttcggcattgtatacggcatctcggatttctcgctcgcgcaggatatcggcgtgacgcgcaaagaggcgggcgagtttatcaaaacctacctcgacacctatccgggcgtgaagaaatatatggattccatcaaggaaaccggccgggagcagggctatgtttccacgctgtttggccgccgccgcgcgctgcccgagctgaagagcaagaacttcaatatgcgctcgttcggtgagcgtgtcgcgatgaataccccgattcagggcaccgccgcggatatcatcaagatcgccatggtccgcgtccgcgaccgcctgctgagagacggtctgcagagccgattgattctccaggtgcacgacgaacttatcctcgaagcaccgaaggacgagcaggaaaccgccatgcgtctgctcaccgaggagatggagaacgcattccggatggatgctccgctggtggcagaggccaaggcggggcacagctggtatgataccaagtaaaagagtgaagagcttggtaaaagagtgaagagtggagagttgagagtgaagagaacgcaagagcgaaatcggccgataatcttcactctccactcctcactctccactctcttaaaaactctctcggaggaataacatggaaacgataatttttgtatgcaccggcaacacctgccgttccccgatggcggaaggcttattccgcgcacataacggcgaggaaaagaccgatttaacggcggcttctgccggattatacaccgaaaacggccttccggcttccgcgaacgcggttgccgcagccggagagcgcggcgcggatatttcggcgcaccgctcgcagcagctgaccgccgagatggccgaaaacgcgaagtatctggtctgcatgaccggctcgcactacgaccggctgtgcgaactgttcccggactgcgcggacaagattttcacgctgctgcccgaggacatttccgacccgttcggcggcgatctcgccacctaccgccggtctgccgccgagatcgacaagggcgtgcaggcggtcatcgagaacctgagccgatgaacatcgtcgtgatgcaggagcgccatctcgcggcgctggcggagatcgagcgcgcgtgctttcacgcgccgtggagcgagaacatgctgcgcgaggagctgggcaagggcatttttctcgtggcggagcaggacggcagaacggcgggttacgtcggctgccagaccgtgctcgacgaggggtatattaccaatgttgccgtgtcgcccgacttccggcggcagggcatcgcgcgggcgctgattgccgagctgacagcgaaagccggagaaaacaagctggcgtttgtgacgctcgaggtgcgcgagagcaatgcaccggcgatagcgctctacaccggagccggatttgcaccggtcggaaaacggaagaatttttacagcaatcccacagaaaacgcggttttaatgacgatttcactgatttgaaggaggattttgccatgctggagcttcgctttgttgacgcggaaaacagggattttcacgacctaaccgccaagctggacgagtattatttcatgctcgtcggtgaggtggagaagcgctacgccaagtacaacctgccgcatctgtttgactgccgcatcgtcgcgtacgaggacggcaagcccgcaggctgcggcgcgtggaagaagatcgacgaggggacattcgaggtcaagcgcatttacatcgcgccggagttccgccgaaagggcgttgcgagcgcggtcattgcggctctcgagcaggatgcggcaaagcacggcttcaacaaggccatcctcgagaccgcccgcacgaccgaggattcggcggcgctgtacaccaagctcggctatcgcgtcattccgtactacggcagtccggcgggcgcggaaaactgcctgtgctttgagaaaaatttaggagattaaccatgaaaatacttgcaatcgagtcctcgtgcgatgaaacggcggcagccgtcatcgaggacggacgaaaaatcctgtcgagtgtggtggacacgcagatcgccacgcacgcgctgtacggcggcgttgtgccggaaatcgcgtctcggcggcacatggaggcggtcgtgcgcgtgactgagcaggcgctcaaggatgcggaaatggacaagcacgatgtggacgcggttgccgcgacctgtgcgcccggactgatcggtgcgctgctcgtcggcgcgaacttcggcaagtcgctcgcctttgcgatgaacaagccgttcattccggtgcaccacatccgaggacacattgcggctacttatctggcgtatccggagctgaagccgccgtttttgacactgatcgcgtccggcggtcacagcgagatcgtgatggtgaaaagctacaccgagtttgaaatcctcggcggcacacgcgacgacgcagcaggcgaggcgttcgataaagtcgcccgcgtgctcggtgtcggctatccgggcggcccgaagatcgacaagctggcgcaggacggcgacccgaagcggtacaagctgccggattcgcacatcaaggatgcaccgctggatttctccttctcgggactcaaaacggcggtcatcaatctggcgcacaacgccgagcagaagggcgaaaccatcgaccggaacggccttgcggcctcgttctgcgcggctgtcgtgcatacgctcgtgccgcggctcgagatggccgtcaagcagacgcatgcgcggcgcgttgtgtgtgcgggcggcgtggcagccaattccttcctgcgggcggccctgcaggacatggcaaagcgcgagcacgttcagctgtttatgccgccgctgcagctgtgcggcgataacgccgccatgatcggcagtcaggcgtattatgagtatcaggcgggcacccgcggcaaaaccctgcagaatgcgtacgccaccgcggatatcggaaagaatatctgcgattaagatgaattgagaattcacttcgtctgcatagcaaaaccccggccttgtcgcttgacaaagccggggctgctcgggtataatatacccaagaggacactgttcagcagtcagaccctcgcaccataattagattatgatgaccgttcggggttcagacgagcggtcatcgcgcttttatacagaagatgtacagcaggattactgcacatacgaaaagctgaaatgcctttttccgcattcgcgccacctccttcctgccgcagacagcgggaaaggaacagagggtctgaccgctatgtgaacttgtccgtttcgattatagcatatacaatcgaaatttgtcaataagccgccttttggggcggttttttgcattttatgacagaaaaaagacggatatatgagtccgtctcttacagcaaaaaataaaaaccgtctgaaaagacggttgattgacacaatatgacacacatgctatcatcgaagtgcaaacggtgaaaattggtatcttaggatacataaagaaataaccgctccccctgaataagaaagcggccttcttctcgacataaaatcgatccgaggaacgaccgctcttggcagagagccgccgtttgtacttaagattatagcgcagagtcccggctttgtcaagcgacaaggccgggactctgttgtttacgcgtcataggaaatcagtccaagctgcattttccagtcgatgacgcgcacggcggaagcgtgaatctgcgactcgggaatcgtgccgtcctgcacggcagcaagcacggcgttgtactgggtcacgaaatccgacgaggtgagcatatcattgcccgcctgtacggcaagcaccgccgcgttttcgccgccggtgtaatcgcggatggcgtccatgatcaggtcatcggtcaggattacgccgtcaaagccgagttcctcgcggagaatgcggtgcacctcggctgagagcgatgccggccggtcggcgtccatgcagtttaccacattgtggctgacgagaaccgactgcgccccgctctcaatacccgcctgaaacggcaggaaatccgactgccggaagatgtccatcggccgctcgtcaatggcgatgccggtgtgcgtgtccgcgttattgccgtagccggggaagtgcttgagcaccatgccggtcttgtcgctgaccatctgcgtaaccactgtgcggacgtattcgccggtctgctcggcgtccatgccgaagctgcgcgcgtaaatgaaatcgctcgggtcggtcgaaacgtcgcacacgggcgcaaaattaacattgatacctaaatcgcgcagcagcgcgtccttctcggcggtgtcgctcgtgatgcggtcaaagccgccctcgcggtacagcgcctgcggtgactggaatttcgtgccgcgcagattcgggttggagctgacgcgcacgaccgtgccgccttcctcgtccgcgccgatgagcatgggcgttttcgcggcattctggtaggctgcgatggtatttgcgacggattctttggtctggccgtcaaaatcgcgcgcaaacagcagatagccgccgatgtcgtactgcgccgtcagcgccgccgcgtcggtctccggacagcgcacgaagaacatctgcgcgacctgctcctcgagcgtcaagccgtccgcatactgctccgccgccgtccggcggacctcctccggcgtgggttccggctcgggctgctcgacggtcggcgcggacggcgtttcgtcctttgcggcggtgtccgtgctgccgcaggccgtcagtccggcgcagagcagacccagcagcagcgcaagcattcgttttttcatgtgcgtcacctcgtttgcctacattatacaagagagcaggggagttgtaaagcatagggtgaatgtggtaatattacaaggtaggagtttgaaggcaggaggatgcgtgagagcggagagcgtgtcactcgttaattatctgcacatgtgcaaccgcaggggcgaacagtgttcgctcacaaaacggaaatccctaatcctgtcacttgttccacacaagaaaggatgttcactatgaacataaccataatctatccgcacaaacggaaaaccaaatcgtccacctacggcattgcacagatggtgctcgaccgcctgctttcgggcggcacgctgcacgaattttatctgccgcaggacatgccgcatgtctgcgcgggctgctatgcatgcatgaacggccgcgaggacaagtgcggcgggcacgaatacatgcagaagctcatcgccgcgattgatgactccgagctgatcgttttctgtgcgccgacctacgtttaccacattccggggcaggtcaagaccctgctcgaccactttgggtaccgctggctggtgcaccgtcccgacctgtcgctgatgtgcaagcaggcgctcatcatcacgaccgcagcgggcggcggcatgaaatccaccgtccgggatttgcgcgacagcatgaactactggggcatcggccgcacgcacgttatcacgcaggccgtctggggatacgactggagcagcatgcccgagaatttcatgcacaaaatcgagcaaaaggtagagaaaacggtttctgccattcagaaaaatgccggaaatgtcacgccgtgcgcgaaggtcagaagcctgttttacatgtaccgcctgttccataaaaagcgcaaaatgaatccggcagacgacgagtattggtacgaaaaagggtatgtaagcggtaaaccgtggaaaagaggacgataatggcaaccacaaaggaatttcttgcggaaatattagaccgcctgtccggactggacggcgtaacgcatcgagccatgatgggggagtacatactctactacaacggcaaaatcgtcggcggaatttatgataaccgcctgctggtcaagccggtcaaagctgcgataagctgccttccggatgcgccttatgaatttccgtacgacggcgcaaaacccatgctgcgggtgatgaaaaccgacgatgccgccctcctgcagaagctgctgcgtgccatgtatgacgaacttccggcaccgaaacccaagaagaaaaagcaataaggagtgaaaaacatgcacaccatcggacgttttgcacccagtccgagcggccgcatgcacctcggcaacgtgctgtgcgcgctgctggcatggctgagtgcgcggcagcagaacggcgaatttctgctgcggattgaggatttggacgaaatgcgctgtccgcgcagcttcgcggatttaattatcgacgacctgcggtggttagggttagactgggacggcgaaatcccgtatcagtccgagcgcacggctgtttacgagaaatacgaggcgattctgcgcgaaaaaggtctgctgtacccgtgtttctgctcgagagcggccctgcacgccgcaagcgcgccgcacctgtcggacggcagggtggtctacgccggaacctgccgcgatttaacccccgagcaagtggccgaaaagcgcagaaagcgtgcgcctgcaacgcgcgtgcgcgtgcccgagcgcaccatcacgttcacggacggcgtgtacggcgagtataccgaaatgctcaccgaggagtgcggcgacttcatcatccggcggtcggacggcgtgttcgcgtatcagctggcggtcgtggtggatgacggcctgtccggcgtgaccgaggtcgtgcgcgggcacgatctcatcggcagtacgccgcgccagatctggctgtatgagctgttcggcttcacaccgccgaacttcattcatatcccgctgctgtgcgaccatgacgggcgccgtctgtccaagcgcgatgaggacctcgatctcggccttctgcgggagaaattcacacccgagcaggtcatcggcgcactcgcctgcgccgcaggactgaccgacaccgcagagccggtctccgcaaaggagctcgtcaaagcgttttcgtgggagaagattccgaagcataagctgtacctgccgaacgtgtttcgagacatcgagaaaaattgagaatggaaaatggagaatggagaatggagaattaccgtaagggttttccgttctccgtttttttatcgggtgcatatcgtttgcatttgattttgtggtacaaattttatcacttgcacaatatttaccgtagggtgcgccaaggtgaattgcccgaagggcaagagaaggtgccctggggtacgaccccggcgcaccgcatgtaaattcatctgcaacggttatcccgtaggggcggtcattggccgctcacgatatggttaaatgggcacgtatccgaatacagattgtaccaaccgtttgatacggtgcgccgaggtcgtcgcaccctacgggatacattttatccaatggtttaaccaacataccataatacaatattatactgtagggcggggtgccctcagaaggtgaattgcccgtaagggcaagagaagccaccctggggtgccccgccgtgtaaatcatctgcacacgcataaccgtaggggcgcacagtgtgcgcccgaaaccggcgttatcgttggtcgtgtgtgggcgaacactgttcgcccctacaggatagattgtaccaaccgtgtgatacggcggggggagggcactccgccctgcggtgatatttctaaatttatgctgtgtttcgataaatgtatattaggttttgatttacgatagtttaatctcaaaacgctggttcacccatcacaataattctccattctccattttcaattctcaatttgcaccggaaaaatatttacaaacaggtcttgacaaatctgtatgtttgtattattatcataatacaataaaacgaaaggagagagcttatgcaatgggaattgcggggggatcgtccgatctatcaacagcttgtggaaaagctgaccgagcagatcgtcagcggacagcttgcggcgggtgaaaaggtaccgccggtgcgcgagctggcggctcaggcgggtgtcaacccgaacaccatgcagcgcgcgctcgcggaaatggagcgcgaaggcctgatgttcaccaaccgcacgagcggacgctatgtaacggaggacagagaaatgattggtaaggtaagagagcaaatcgcgggagagcgcatcacggaatttctgtccggcatgagccagcttggcttcaccgagcaggacattgtggcgcttctggagaaacgaagtggggaggaaaaaaagaatggataacaacgaactggttatctgtcaggaactgacaaaaaactacggtaaaaagaccgcgctcaataatctgaatctgacgctcggccgcggacagtttatcggtctgctcggcccgaacggatcgggtaaaacaacgaccatcaagctgatgaacggtctgctgcagccgacaagcggctcggtgctcattgacggtcaggcgccgggcacctacacgcacagcattatcagctatctgcccgacaaaaactatctcaacgatgcgatgaaggtcaacgacctgatttcgttctttgcggatttttacacggattttgaccgcgtaaaggcaaccgatatgctggattcgctggggatcgacccgctgaaccgcctgaaaacgctcagcaagggcaatcaggagaaggtgcagctcatcctcaccatgagccgcaaggcgcagctgtatgtgctcgatgagccgatcgcgggtgtcgatccggcagcgcgcgactacattctcagcaccattctctcgaattacagcgaggacgcgtccgttctgctgtctacgcatctcatcgcggatgtggagcgcgtgcttgacgaggtcattttcctcaaggaaggcgcgatggtgctgcacgacacggttgaccatatccgcgaggagcacggaaaatcggttgacgccctgttccgggaggtgtttgcatgttaaagctgctgaaatatgagtggaaagcctgcgcgcggacctgtctgccgctgtacggcgtgctgattcttatgtcgcttatcagccgtatactgtatgtcattccgaagaatgcatcactggactttatgctgcccgccatcggctccatgctgtatatgggcgtgatgatggccgcatttgtggtaacggcggtcattctcatccagcgtttttacaaaaacctgctcggcagtgagggctacctcatgttcaccctgccggtcacggtttcgcagcacctgctcagcaagaccattatcgcggtcgtgatgattggtttgagcggtctgtcggcgctcatcagcatcttcatttttgcggataggatgattctgtcgatggatgaggtgtggcaggcttttaccggtctgagcactctgctgccgcacagcggtcaggagttcctgtttgaactggagctgctcgtgctggctgtcctcggcattgcgggcatggcgctgttcctctatatgtgcatcgcgctcggtcatctggcaagccgtcaccgcctgctcatgtcgatcgtgtggtacgttgttctttctaccgcactgcaggttctcctgcttatggtgatgatgggtgcgggcaatgccgtgccggagccgttcgtagacctgatgaaagtctggtggagcggcattacgccgatgggcgcagcgcatctcatgctgcggttctgctgcgtattcacgctgctcagtgacgtggtgtatttcctcgttacgcggtggattctggtgcataaattaaatcttgaataaacagcaggagcacaccaaacggtgtgctcttttgcttgctatcagggcgtatctctggtatgattaaaatagtaaaagggaggtgtgtcctgtgaaatgtcagcactgtggtatccattttgacgatgaggaacgcgtatgtccgatgtgcggcgcacgcgcgggcagcaaaggccgcatgacgagacccgcgccgaaatggcacggcaagccgcgcgagacctacaccgaatatcatccgacgatagagaacagcagctcggcgaaaacggcgaagagcaaggcgcgtcccatccaggataagccgaagaaaaacagcgcaaagggtgtggtgattgcgataattgttatcgctctgctgcagatcgtaccggctatcttcgcgtttgtggtggatgatctggtgccggagattgagagcagcttcggaaatgcccctgcaccggagtatgattcggattacagctatgattatgatacggactacgattccgactatgcttacgacacgctctacgatgtatttggcgacaacggcattacggtgtcggcgtttgacaacgtctatacgtttcaggcttccggcgatggcagcagctatgagttctcatacaccgagaacggcaacagaacattccgcagcacgggcacggccttctgctaccgcgaggacgatgaggactattattatcgggatgagtacccgtacgacgagtacattatgtacagcgtttacctgtatccggagcatcaggagaccaacggtccgcagcaggactggtgcgattctatgatgcggagcacggtggacagtattttgctgaatgtgttccaaagccgcaccacggatgaggttgtcgtggaggatatggacggcgtcggcctgttcggcagcggcaatgttttgccgtttaataaggtgcaggaaggatagtaaacatcctgccgaaaaacagcagccccggttctgtcacttgacaaaaccggggcgccgcgctataatatagctacaaacggcggctcgttcgcaccgagcggtcgttcctcagatcgattttatgtcgagaagaaagccgctctttacaacgggtgcggttggtttatttcttcatgtatccgaggataccaaagacgatcatggcgatcaactgaaacagaagcagtgcttcggacagcgacatcacgatcacctccctcctcatcgagggaggaacaaccttttttcaccgtttgctgatttgattatagcatgcggacaatatcctgtcaatcaaccgtccttatgggcggtttttgtgtttttacgggagaattttgtgtatatgcaaaagaaaagtcactcataaattgaatagtaacttgtgacgcgcaagcgcattcggtataatgatagggcagaggagggggaacgccgcatgggacggcgaccggctggtcggtctcgtgcgcctgctcgatgacagcgaatatatcgaaatcatgcccgaggagagcaaaaacgctgccttctgcctgagaattaccgctttccggcaattttcgcaatggtttccgccgcattctcctgatgcacctcggcgggcttgaactgcacggctgcaaaattgaggttgatcagcggacccagtccgacggcggaaataatggtgccgacaccgaccggaccgccgagaaagaagccgatgaccgttacgagcacatctacgactgcgcggcacgcgccggcagatcgcccgaacttacgcgcgagcgcgaccatcagcgcgtcacgggggccgctgccgagcgcgcttttcatgtacagccaggtgccgagcgcaagcagctccagaccgccgatgagcatggcaatgccgctcaccaatccgtgcatctgcgggatgaggtgcgccgcctgaatcgcgtcgattatgaccgcgcagcccgcaatgttgatgatcgtgccgaagccgaagctctcgccgaagagcacggccgtgaggatggctgccgcgcctgcgatagcggacgctgtgccgtaggtcatgccggttcgcagcgacatgccctgctgcagcacgctccacggctcgagtccgacatttgcctgcagcatcatcgcaatgccgatcgaactgaccgcaacacccaggatcagccagaacaaccggcgcatgtaattttgaaacatgagagcatcctcctgctatcagactaaagcgaggtaaagtaaaacggcaaaatcggaagaatttcgctccggttttgccgtttgagttttgatcttgttattccgaagcggaattgctgtcgtcctttttaatctgggaaagatagcggtacacactggcctgcgagcagtgcagcgcgtcggccacatccttgaccgcgcccttcagcaggaagataccgccgttttcaagcgaagcaatgatctgcatgcgctcgtccggcgtgagacggtcggcggtcacgccgaggcggatgagctcgcggccgaccgcatcgcctgccaccgcgtcgatcgagttgtggaagctctcggtcgttgccggaaccgctcgcgggaacggatcaccgggttcggcctgctgcggtgcgatatggtcgtcgataaaaatatccggatgacacagccgcagcacgttttcgctggcggccagataccggctgtcgtcaaagttgatgcacagcatgccgaccagcttgctgttgtgcttaatgaacattgtgctcgagcgcagcgtcttgccctcggcagagaggccgcagtagtgcaggcggtagtcctgcgtttcgtagcttttgtccatcaggattttgagcgccacattggtaagcggtgcgccgatctcacggccgctgatgtgattgttggcgatggctactatggagcggtttttgtcggtcatatcatgcagagcaacctcataatccggtccaagtgcttgtccgagaaattctgtcagcttgatgtagtgctgcaacagcggattagccatttgcccaccccgtttcaaagaattttctttgcagtgcctttgattgcatggcattgcctttttattggtttactctaatattattatagcttaacaatgataagtttgtcaaaaaataaacgcaaataatttctcacaacaaaaataaaaagttattatgcaaaataactaaaatgaggataaagtgcataaaaaacttgtgaaaaaccagtaaaccatacaaaacttgttaaaataattgacaaggcgtaaaaaccatgttaaatttatatcaaggaatgagacacagactgataaaaaattacaaaactgaagaaaagggaatgtaaaaatgaggagtagagaaagggagaatgccatgaattctgattttcgagacaagctctccaacgccgcaacagtggttgagatcacccttggcatggtgatcctgatcgcgtgcattgtgtccggcatcggcatggtcgccatgaccgatatgaacaagctgttcggtgatccggcgtatctgcaggcgcgcatgagctcagcctgcctgatcatcatcggcatcgagctgatcaagatgatcaccagctacaccattgactcggtggttgacgttatgctcctcgccatcgcgcgtcagatgatcgtcgagcatacctcgccgatcgagaacctgatcgccgtgctgtcgatcggcatcctgttcgtgatccggaagtatctgtatatttcgcgtctggaccgccgccgcagcaagaaggagatcgaggaggacatccgcgcagaggttctcggcgtggaaaaccgtaacgagccgaaaaagccggaaccgcccgagattggctcattgatttgacataaggaaaatgcatatcacctgaaaaccgcagcgcccgagagggcgctgcggtttttcattggaaaggatacagataaattagttcatttattcacaatatcagaaaaagtttataggcttgaacccgcgtttcactcacactttcgctatgttggcaggcttgcaagcgatttgctgcgattcacataacagcgtaaatagtacgcatattataccgataaatcgttttctgaatgatattactgcttcttgcgttgtaaattcgctttatgcaccaaaccgcatctgcagccgcagccggtcggcaatcatcgagataaattcgctgtttgtcggttttcccttgacgcccgagaccgtgtagccgaagtaattctgcagggtttcgatgtcaccgcggtcccacgcgacctcgatcgcgtgccggatagcgcgctccacgcgggaggaggtcgtcttgaactttttagcaatcgacgggtacagcaccttggtgatggcgctgaccgattcgatatcctcgactgccatcatgatggcctcgcgcagatactggtagcccttgatgtgcgccggcacgcccacctgatgaatcacctcggtcacgcggagctcaagcgccatgctttcctcggccttgaccgcgcgcagctgaccggtccgccacaggcgaagccgctcgcagaccgcctgcggctccatcggcttgcgcaggaacagatccacgccgagcgccgcgcattccgcgccgatctgcgggcttgcaaacgccgagaataccattaccgccggatgcggtccgtcctgctcgtgcaggcggctgagcacgctcatgccgtccatcaccggcagcatcagttcaatgataagtacatccggccgcagctcattgaccgcggaaagtgccttttcgccgttttccgcaatgccgaccagctcaaaatcgtccgcactgtccagcaccgccgacatgcgcgcgcaaaattcggtgtcgtcgtctgcaagtaaaattctcattttctcattcatatatcataaccagctttccgataaatttcatctctttttcttggcaatagattaccatatactaccataacttgcaagaccttttgtaaaaatttggagagaaaattgccgacagcattcgacaaaatctgtcgatttacccaaaatgaccggtcagaccgactgcttttacaatttctgcatattttcaaaatttcccggaaatagacaaaatacaagcaaaactgcggttttcgacaacaaaacagtggttattaactcaaaagaaagggcgcacaatgtgcgcccaaacgcaaggtaaacccctcacggccgcagcgcgaacagaactcgcgcaaggatagcggcattttccattttcaattctcaattctcaatttttaaccggccgccagcattttctccatcgaaatgccatacccttccatcggattatcgaccagcacatgcgttaccgcgccgatcagcttgccgttctgcaggatcggactgccgctcatgccctgcacgatgccgccggttttctccgcaagctgcgaatcggtcacgcggagcatcatgctgcgcccgtattcgtcgttcgccggatagagcttgacaatctggacagaataacgctgcacgctgtcgccgtccacgttggacaggatttccgcgtcaccgattttgatttcgtctgccgacgcgaccggcacgcactgcagctcgctgtacagcgaatcgtccgttatggtgccgaaaatgccgctttctgtgttctgcgccacggttccgagcggcttttcggtcgaaaattcgccctgcagcgaacccggttcacccgccttgccgcgctgcacgctgctcaccgtcgagtgaatgatcgtgccctcctgcagcggcagcagcacgccggtctcgctgtcgcagatgccgtgaccgagcgagccgaacgcgccggtctgcgggtcaacgtaggtcagcgtgccgattcctgccagactgtcgcgcgcgagcacgccgatgcggtacgcaccggttttgtccctgcacggtgtcaccgtgacgcttttctccgcgtctccgcgctcaagcgtcagcttgatcggctgtcccgccgagagcgcgacctgcttctgcagatcgtcgttcgagtgcagcgcggtctcaccggcgcggcacagcacatcgccctcctgcacgcccgcctccttcgcaggggagtgcgtgccgtccgcgccctgcacctcggtcagctgcacgatgagcacgccctccgcctgcattttgatgccgaccgtgtgcccgatcgggatgacctcagcgatttttgccgcctgcgcggagactgtcaccgcaaacagcaggagcagagcgagcgccgtgcgttttgcgtgatttttttgcattttttcacctccgctattactatgccgcgcggagcatgaaaacaacgctgtgaaccttttctattctgccggacatttggcggcacggaaattctctgggcgcggaaaggttttccgggaatgcaaaacggcagtttctctgcgaaaaatgagagaaactgccgcaattagcaatcatttattctgcttttgcaggcgcacgatgaccgaggaacgatgctaccgcacgggcgagcacgccgccgaccgcacagccgacgataatctcgatcagaccctgtacgccgaccagtgcaatcacgaaggacagcgggttagccacgccgagagaggcaacgcgctcctgaatgtagtcggtcttgtagaacaccagaacgatgtaacccatgaagaaaatggtattcagaagcggcgcggacatcgcaccgacgaaatagctccagctcttcttgtggtccacgcggcgcagcacgcggaacagcaggccgacacaccagcccatcagcacgcgcatgacaacgcacagaacgaaggtgttgatcgggctgatctggaaaaatacgcttgtcatagccgacacgccggtgatggcgtccttcatgctgaccagaccgaatacgccgccgaggatcgcaccggcggtcggacccatggtcatcgcgccgactgcgatcggcacggtcaggaacgacatgtacagcggaccgaccggcacgctgcccagacccatcagcttcatcacgacctcgatcgccgccagcagcgccagctgcgcgagataccgtacattggtagttttgttattcatttgtaattcctcctgctgccgtcctgctttgacaggtacagcgcaatacaaaaattgtggtggtcagcgatagaaattcgctgccaaatctctttcaaccccgatttttcttccaaatcaggtgcagaccgtcgagcacaaggctttcatcgtactcgaacgggatacgcagatagggagtgacgagcggcgcaagctctccggtgagcacgacatacggcgtttcaccgagcgcttccgcaaagcgttcaaccatgccgtccacgagcgatgcggcaccgtaaaccgcgccgacgcgcatggcatcgaccgtgttccgggcgagaatgccctcgtccttggcgtcgatggcgaccgccggaagctgcgctgcctgctcgcggagcgcgagcagactcagctgcacgcccgccgtgatggctgagccgaccagcgcaccggactggtcgagcgcggtgaacgtggtcgcggtgccgagcgtaatcgccacgcacggcagctttcccttggcacgggcggccaccgcagcggctacgcggtccgagccgacctgccgcggctgctcggagcggatgttgagtccggtcttgacgccgctcgatacctcgatgacatcgcggatgccgagcaggcgcagcgcaccctcgagcacgccgaccatgctcggaacgaccgagctgacaataccgccgtggatgcggcgcacgtttacgccgtacagcaaaagcacctgctgcagcttgcaggcgtagtcgtcgcgcgtcagcttaggctcggttgcgatggaggcagaaaaaacctgtccgtcctcctcatagccgccgagcaaaacgcggctgtttcctgcattgactgcgatcagcatggtgtgtctccttttctgcatagtttaccactattataagccattgaaaaccgtattgcaaggggagaggcatacattttcgtcttatttcggcagcatgatcggcgcggcgagcagcgtccacaacacggcgtatttcgggcagatctgtccttgcacattgccgaattcgtgcgagtaatcccacacgcgcagccggaaatgccggttgaccgtgcagccgaccacatattccgccgccgtgatgcatgccgcgccgcacaggcagcgggagagcgggctttcctcgtgtacgcgccgccgcagccgccgcagaccgaccagaacggcaccgccggtcagcgccatcgtccagtgggtgcgtccgcgccagagaagctcgagcgcggcgtagccggccgcgcccagcgcaaagactgcgggagtttgcagtttcattttcatcaccgcatttattttacccggaatggcgggatttacgcaagggaggagtaattgagaatggaaaatggagaatggagaatgaacgtggagatttggcattttccattgtgtggtttatcggtgcatatggtttacaaggacgcgcaatgcgcgccctttgttggcggtatgcacacgcattaccgtaggggcgaccactgatcgcccgcaacaaataaaaccgtatcgttcattttccattctcaattccgactcgctaagagccgcctacggcggttgctcgctggacgcccactgcggtgggtgtctcaattctccatttggcatacgcgcaaaataaaaaggagagagcacaacgctctctccttgaatacagcaaagggattcagtcttccagcttgacacgcgcttcgaggtactttctccgctcctcgaaacccgatctgcccagaagtgcaaacatattcttcttataatcctcaacacccggctgattaaacggatttacgccgagcaggtaacccgaaatgccgcaggccttctcgaaaaagtagaccagatagccgaaatgccatgcatccgtgcggtcgatctcgaggatgatattcggcgtgccgccgtccatgtgggcgatcagcgtgccctcgtacgccttctggttgacgtgctgcacggtctgacctgccagataattcaggccgtcgatgtcctcttcggtatgctcgatggtaatctcggagcgcggctccttgacccacagcacggtctcgaacatgatgcgcgagccgtcctgaatgaactgaccgatggaatgcaggtcggtggagaaattcgctgaggtgacgaacagacccttatggtccttgccctcggactcatcgaacagctgcttgagccattcgccgagcatgacgagcgacggctcgtagtttaccatgatctccatggatttgcccttgaacagcagcagattacgcagtgccgcatagcgcgcgcagtcgtgcaaggagccatgagaatattcctcgcgggcggcggcagcgcctgccatcaccgcgtcaatgtccagaccggctgcagccatcggcagcagaccgaccggcgtgagcaccgagaaacggccgccgatgtcatccggcacaataaaggtctcgtagccctcgtcatccgccagctttttgagcgcgccgcgttccttatccgtcgtggcgaagatgcgctcgcgcgccccctccttgccgtatttgctttcgcacagctttttcagctcgcggaaggcgatggcaggctcggtggtcgtgcccgacttcgagatgatgttgatgcagaaatcgcggtcaccgatcatcttgataatgtcgtttaagtaggacgacgaaatgttgttgccggcaaagtacacctccggaatgccctccgggcggacctggttgtagaactgaccgtttacgaactcgatggctgcccgtgcccctaaatacgagccgccgatgccgatgacgatcagcacatcgcaggtctgctgaatcttctttgccgcctgcttgatgcgcgcaaactcgtcccggtcataatccaccggcagattcagccagccaagaaaatcgtttccggcgccagtgccgttcacgagcgtgtcctgcgctgccgcgacctgcgcggtgtagtccgcaatctcggcctcggttcggacaaatcgccggagaccggtcagtttcagtttaattcccattactgcatttccccttttgttatttcctccaagccatttggcgggatttgctctccctctcgtatctaagtatagcatactgacgggaaaaggcaagcgttttgttcaaaccttacaaaaactttatctgctcgactgtttatgacaggtaattttgcattatgcaaaccgaacaaagccaaccaaaaagccgattcccatagtagagaatcggcaaaaattgttagtaaattggaaaatttgcgcagatatcgcgtacatttcggcggatatcgtttgccttgttgtcgaaatcggttgcggcctgccagatgaactcggcaatgcggagcatctccggcgcaccgaagccgcgggtggtgacagcgggcgtgccgatgcgcatgcccgaggtgacgaacggactttccgggtcgttcgggatggcattcttgttggcggtgatgtatacctcgtccagacggcgctgcagctccttgccggtcacgccggtctttcgcaggtcgatgagcatcaggtggttgtccgtgccgccgctgaccagatcgaagccctgcttctggagtgcgtccgcgagcacgcgggcattggtgacgacgcgctgctggtacgccttgaattccggcttgagcgcctcaccgaagcagaccgcctttgcggcgatgacatgctcgagcgggccgccctgtgtgccggggaagatggccttgttaaacttcttcgccagttcctcatcgttcgtcaggatgacgccgccgcgcggaccgcgcagcgtcttgtgcgtggtggtggtgacaacatccgcgtaagggaccgggctctggtgcagaccggcagctaccagaccggcaatgtgcgccatgtcaacgaacaggtacgcgccgacctcgtgtgcgatctcggcgaattttgcaaagtcgatggcgcgcggatatgcggacgcaccggcgatgatcatcttcggctgttccttttttgccagctcgcggagcgcatcataatcaatgagaccgttctcatccacgccgtagggcacgatgttgtacagcaggccggactgattgaccggcgagccgtgggtcaggtgaccgccgttgtccaggctcatgccgagcacggtatcacccggcttgcacagcgcctgatagaccgccatgttcgcctgcgcgcccgagtgcggctgcacgttcgcgtatttcgcgccgaacagctggcacacgcggtggatggcgaggttttccacctcatcgacgcattcgcagccgccgtagtagcgcttgccgggatagccttcggcgtacttgttggtcagcacgctgcccattgccgccataacagcctcgctgacgatgttttccgaggcgatcaactcaatgttgcgcgcctgtcgtttgtattccgcttcgatcatacgtccgagttcgggatcgaacgccgtcacgaagtccattgtttgacgaaccatgatacagcctcctgcgggataagaatttactattataattaaaccacatttttcgcatggaatctattgacaaacatctgatttttgcgttaacgctttagcagtttatagtgaaattgttacattgtgcatttttgtgcaaatagttgcccttttttcgacgatatgctacaattatcgtaggaaaacttgtggagagaggataacaaaatgactaagaaagaacgtgccgccaccgttaccgagctgctgaaaaccgtctatccggaggcggtctgcgccctgcattatacacacgattatgaattgctgttcgccacccggctttccgcgcagtgcacggacgcgcgcgtcaatattgtgacagaaaaattattcaagcagtttccgaccctgcagagcttcgcggatgcgtccgaggaggagattgccgaggccatcaagacctgcggcctgttccgcaccaaagcgcgcgacctcaaggcgtgcgccatgatgctgattgccaattacggcggcagggtgccggataccatggaggagctgctcaagctgcccggtgtcggccgcaagaccgccaacctcatcctcggggatattttcggcaaaccggccattgtgtgcgacacgcactgcatcaggctgtccaaccggctgggcttcgtcaagaacgagaaggacccggtcaaggtggagaacgccctgagaaagctgctcgacccggcggagtcgtccgatttctgccatcggctggtgctgttcggccgcgagcactgcaccgcccgcagcccgaagtgcgagggctgtccgctcggtgcggtgtgcccgtcgtatcccattgcgaaataacatagaggaaaagtaggactttgagaaaaaatgcaaaaaatccacttgacaaattctcaccgtgggaatatactgatttcagaaaaagcaaaaccgtagaacaagagtgagtaagagcgagaccgtgcttccagagagctttccggtggtgtgaggaaagcagcagaggacgttactgaatggacttgtgagggcagcctcaaatccgcagggagagtatggctgacgggattcccgccgttaccatgggagcgtgtgtgtttgcacacgacagagtggacgttctttgacgtcaatttgggtggtaccgcagaagtaacaggcttttgtcccatgatgcacttgcatcataggacagaagcctttttttgtttgtaaatggaggaaaacacaatgattaccccaagctgtgatgagattttagaactcgcgaaggagtatacgaccattccggtctgccgcgagatctacgccgatatgacaacgccgatcgcgctgctgcgccgcctgcagactcgttccgaccgctttttcctgctggagagcgtggagggcggcgaaaaatgggcgcgctactccttcctcggctacgacccgatcctgcgtgcgacctgcaaaaacggcacggtaacgctcgagggtacggtgaacaggacggtaacgaccgacaagccgctcaccgtgctccgcgaggtgctcggcgagtaccgcgcaccgcggcttgagggtcagccgccgttcacgggcggttttgtgggctacttcgcgtatgcgatgctgggctacgccgagccgaccctcaatatcaagcgcggcgcatgggatgatttcgacctgatgctgttcgacaaggtcatcgcctatgaccacctcaagcagaagatcgtgctcattgtcaacatgaagaccgacagcgtgatggagaactacggcaaagcctgtgccgcactcgagggcatggcggcgctcatcgcagaccagagcccgctgccgccgctcaaagtcaccggcaggccgaacttcacctgcaacgtcaccgaggcgcagtacgccgacatcgtggaaaagacccgcgagtacatctttgacggcgatatctttcaggccgtgcagtcgcggcagttctccagtccgtatgcggacagcctgctttcggcgtaccgcgtgctccgcaccactaacccctcgccgtacatggtgttcctctccattgatggagatgaaatcatgtgctcctctccggaaacgctcgtgcgcttgcaggatagccgtctgacgactttcccggtggccggctcccgtccgcgcggcaaaacgccggaggaggataagacgctcgaaaacgagctgctggccgatgagaaggagctttccgagcataacatgctggtcgatctgggccgcaatgatctcggtagagtttccaagatcggcacggtcgaagtcaccgattacatgatgatacaccgctattccaagatcatgcacatctgttcgcaggtcgagggcgacattgacgaaaagtacgacgcctgcgacgccatcgaagccgtgctcccggcgggcacactgtccggcgcacccaagatccgcgcgtgcgagatcatcgaggagcaggagagcgagccgcgcggcgtatacggcggcgcactcggctatctggatttcaccggcaatatggatacctgcatcgccatccgcatggctgccaagaagaacggcatcgtgaccgtgcaggcgggcggcggcatcgtcgcggattccgtgccgtataacgagtatatggaaagcgcaaacaaggcaaaggcagttatgaacgccatcgagcgcgcttcggaggtagacggataatgattctcctgatcgacaattacgattctttttcctataacctgttccagcaggcggcggccatcgagccggaaatcaaggtagtccgcaatgatgcgctcaccgtcagcgaaatcgagggactgaacccctcgcacatcattctttctccgggtcccggctacccgaaggacgcgggcatctgcgaggaagtggtaaagaggctcggcggcagcatccccatcctcggcgtgtgcctcggtcatcaggccatctgtgaggcgttcggcggccgcatcgagcacgcacagcagctcatgcacggcaagcagagcatcgtcgaggtggataccgaagagacgctgttcaagggtctggcaaaaaagaccatggtagcgcgctatcattctctggtcgctgcaccggattctctgccggagtgcctcaaggtcatctcccgtgacgaaagaggagagatcatggccgtaagacataagaccatgccgatttacggcgtgcagtttcatccggaatccatcttgacaccgcagggaacgaccattatgcagaactttttgaaaatggagaattgagaatggagaattgagaattaaggtatcgcgcagagcgccgcacattgtcgcagcacggacggaactcgcgcaaggatagcttgtcgcagcgcggacggaactcgcgcaaggatagcgacattttccattttccattctcaattttcaattacttagagatttaacatttacaaaagaggtacgaattatgattcagcttgcaattcacgaggccatcaacggccgcgatctggactacgccatcgtccgtgcaacgatggaagaaatgatggacggcaccgcgaccgacatcgaaatggcaacgctcctgacagcgctgcgtatgaaaggcgaaaccatcaccgagattaccgcctgcgccgaggtcatgcgcgaaaagggcgcgcacattgagccgaagggcgcggtcatggacatcgtaggcaccggcggtgacgaggttggctcgttcaacatctccacaactgccgcattcgtggcggcggcgggcggcgtgtcggtggcaaagcacggcaaccggtcggtttcgtccaagtcgggtgcggctgacgtgctcgaggagctgggcgttgtcctgtcgctgtcgcccgagcagaacgaaagggtgctggcggaaacgggcatctgcttcctgttcgcacagggctatcataagtccatgaagaacgtcgcgcccgtccgcaagggcatgggcgagcgcaccatcttcaatgtgctcggcccgctgtccaatccggcgcgcgcgaccatgcagctgctcggcgtgtacgatgaaagccttgtcatgccgatggcgcaggtgctgtccaacctcggcgtaacgcgcggcatggtggtctgcggcggcggtatggacgaggccagcctcatcggcaggaacaaggtctgcgaaatccgcgacggcaagctgacgccgtatgagctcgacccgaccgaatacggcctttcgctctgcacggtggacgagctgcgcggcggctcgcccaaggcgaacgcacagatcacccgcgacatccttgcaggccgtgagcagggcgcaaagcgcgaggagattttgctgaacgccggtatcgcgctgtacctcggtctggacggcctgacgctggcggacggcatcaaaaaggccgcagagattatcgacagcggcgcggcgctcgcgaagctcgaccggttcgcggcggcaacgcaggaggcggcaaaggcatgatcctcgacgaactggcggcgcacgcccgcgagcgggtcgcggcggacaaggcgaaaatcccgctcgaggacatgaaggcgcaggcggaagccctgccgaaaggcgattttcggttcgaaaaagcgctttccggcaaagaatgtgcgttcatctgcgaggtcaagaaggcaagtccgtccaagggcgtcatcgacccggtgttcgactttgagaaaatcgcgcgaagctacgagaacgcgggcgcggactgtgtttcgtgcctgaccgagccaaagtggtttctcggctcggacgaaatcttcaaaaaggttcgaaagatcgtcacaaagccgatgatacgcaaggatttcacggtggacgagtaccagatttatcaggccaaagtcctcggcgcggatgcggtgctcctcatttgcacgctgctcgacaccgaaacgatacgcgattatatcggcatttgcgacaaattaggcatgagcgctttggtggaaacgcacgatgcacaggaaatgcagtccgcggttcgagcgggcgcgcggctcatcggcgtgaacaaccgcaacctgaaggactttacggttgacctcggcaacgcggctcgtctgcgcgagggcgcaccggacggtacggttttcgtagccgagagcggcgtttcctctcccgaggatgcggcggcactgcgaaagaccggcgcggatgccgttctggtaggcgagtacctcatgcgtgccgcagacaagaaacaggcgcttgacgcactcagggaggccacaaaatgaaactgaaattctgcggactgacccgcaaagcggatattgaggccgcgaacgaaacaaaaccggactttatcggcttcgtgttcgcagagagccgccggcatgtgtcggatatggatgcggcgcggctcaaggagcacctcgacccggaaattaaggcggtcggcgtgttcgtgaacgacgaacccgagcacatcgccgcgctggtgcgcgatgaggtcatcgacatcatccagctgcacggcggcgagagcctgcattatataaacaagctgcgaaagctgacgaacgcgcccattctctacgccgtgcgcgtggaaacgcaccgcgatattgagcaggcggacaagctgccggtggactggctgctgctggatacttatgtaaagcacgcctacggcggcagcggcaaaacgttcgactggtcgctgatcggcgaggtaaaccacccgtattttctcgcgggcgggctgaatgaaagtaacgtccaaagagccgcacagaccggcgcgtatgcgctcgacctgtccagcgacattgaaacggacgatgtaaaggatatggacaagatgcgccgcgtatcggcgcttgtgaaaggagcaaaccaatgagcaagggacgttttggcgtacacggcggccagtatatgccggaaacgctgatgaacgctgtcatcgagctggaggaagcctacaaccactataagaacgatccggaattcaacgcagagctgaccgagctactgaacaactacgcaggccgtccgtcgcggctgtactttgcggagcatatgacccgcgacctcggcggtgcgaagatctacctcaaacgcgaggatctcaaccacaccggcgcccataagatcaacaacgtgctcggtcaggcactgctggcgaaaaagatgggcaagacccgcctgatcgcagagaccggcgccggtcaacacggtgtagcgaccgcgaccgctgcagccctgatgggcatggagtgcgtggtgttcatgggtgtggaggacaccgagcgtcaggcgctcaacgtgtaccgcatgcgcctgctcggcgcggaggtcatcccggtttcgaccggcacgggcacgctcaaggatgcctgctccgccgcgttccgcgagtggacttcccgcattgacgatacgcattactgcctcggctcgtgcatgggcccgcacccgttcccgaccatcgtgcgcgatttccagtcggtcatctccaaggagatcaaggagcagatgctcgaaaaagagggcaggctgccggacgtcgtgatggcctgtgtcggcggcggctcgaacgccatcggcgcattctacaacttcatcgaggatgagggcgtgcgcctgatcggctgtgaggccgcaggccgcggtgtcaataccgcagaaacggccgcgaccatcgctaccggccgtctgggcattttccacggcatgaagagctatttctgtcaggacgaatacggccagatcgcaccggtctactccatctcggccggtctggattatcccggcatcggcccggagcacgcttacctgcacgacatcggccgcgcggagtacgttccggtgacggacgacgaagcggtaaacgcattcgagtatctcagccgtatcgagggcatcatcccggccatcgagtccgcgcacgcagtcgcatacgcgatgaagctcgcgccgaccatgcgaaaagaccagaccatcgttatcaatatctccggccgcggcgataaggactgcgcggcgatcgcacgctaccgcggcgaggatattcatgagtgattaggaaatttatgcatcgtttttgaatatatgccgtagggcgcgacgactcggcgcgccatgcaggccgtatgcacatcgttaccatcggcgtgccgaggtcgtcacgccctacgaaaaaggagcaagctatgagcaagataaaatctgccttccggagcggcaaggctttcattccctttgtaacctgcggtgacccgtctctggacgtcaccgagcagatcgtatacgcgatggcggacgcgggcgcggacctcatcgagctgggcattccgttctccgacccgaccgctgagggcccggtcattcaggaggccaacgtgcgtgcgctgtctgcgggcacgacgaccgacaaaatcttcgacatggtgcgccgcatccgtcaaaagaccgatattccgatggtatttatgacgtatgcgaacgttgtatattcctacggctcggagcgtttcatccgcactgccgctgagatcggcatggacggtctcattctgccggacgttccgttcgaggaaaaggccgagtttgacccgctgtgccggcagtacggcctcgatctcgtgtcgctcatcgcgccgacctcgcacgaccgcatccgcatgatcgcaaaggaagcctccggcttcgtgtactgcgtgtcctcgctgggtgttaccggcgtgcgctcgaacatcaccaccgacatcggcgcgatggtgaagctcgtcaaggaggcgcaggacatcccgtgcgcggtcggcttcggcatttccacgcccgagcaggccgcaaagatggccgcccagtcagacggcgcgatcgtcggctcggcaatcgtcaaaatctgtgcaaagtacggcaaggattgcgtgccgcacgtcaaggagtacgtcaagagcatgaaggacgcggtgcggaacgcaaattgaaaattgaaaatggagaatggagaatgaacgcgacggtcaaacgggtttcggttcatttttcattggttcattgatgttcaaatgacaaaacgagggagaaacggttggttctccctcgttttttgcgattattgaggtagatggagttattccgcccaatgggcggcaattcaatcatcgcgcttgcgcgataccgcaattctcaattctccattctcaattttcaattagtaattgttagccttgagttcaaagtaggctttaggatgcgcgcagaccgggcagacctcgggcgcctgcctgccaaccacgatatgtccgcagttggagcactgccatacgcagtcgccgtcgcgggaaaagaccagcttatcctcgacgttcttcagcagcctgcggtagcgttcctcgtgctccttttcgatcgcgccgaccatctcaaacagatccgcgatgtgatcgaagccctcctcacgcgcctccttggcgaaggtggcatacatgtcggtccactcgtagttttcgccctctgcggcagccttgaggttggctgcggtgtcgtcaatgccgccgttgagcagtttgaaccagattttcgcgtgctccttctcgtttgcggcggtttcctcgaagattttcgcaatctgcacatagccgtcctttttcgccttggaggcaaagaacgtgtacttgttgcgtgccatggattcgcctgcaaatgcggtctgcaggtttgcttcggtgcgggtgcccttgagttctgccataatagttatcctttctccgctattcttccagttgacggtcagaccgttctgactgctcttttagtctttcctgcaagcgctgcaaataccctcaaacagaatttcgtaccgatgcagctccacgccggaggaatcctccacgcggtcgatgagatcggtgacaggcggcataaatacatcaaaaacgccgccgcacttggtgcaccgcacatgataatgcggcttgatgttgaaatcaaagtgatccgcgccggtcggcaccggcacgcgcaaaatctcgccctgtgcggccagctggttcagattgcggtaaaccgtggccttgctgatggtcgggtgctgcgccgcgataacggcataaatcgcatccgcggtagggtggttgtgcatctgattcactgcctgcaatacgatctgacgctgaatggtgtttctggtctgcataaaatgcacctcctttattagtattatatcctaattaagagtatattgtagatttattcttttgtcaataggaaggaataaaattgagaattgaggatggaaaatgaatacagaatcaaaccgtttgacgaatggtttgtcgggtgcggatggaaacgaaaacgagccgtgaatcacatgaagattcacggctcgtttgttagagaacatatagaaacaccatcaggtaatgacaaacgctgccgacgattacgaacagatgaaacagctcatgaaacccgatcattttacctaaattcggctttttggcgatatagatcacgccgccgaccgtatacgacagacctccggcagccagcagggcaatggcaggcgcgggcatggacagcacaaccccgaaatcaaatgcaatcgcccagccgagcgcgaggtacagcgcggtgccgatgagacgcggcgcgtcaatccacagcagcttgatggcaatgccggtcagcgcaatcagccagatcacgccgagaaagacatagcagcgcggcgcaggcatgaatttgagaataatcggcgtatagctgcccgcaatcagcacatagatcatgctgtggtcgagctttttcagccgccgcaggacggcttcgccgcggccggagaaatggtacacgctgcttgcggagtacagcgcgatcagcgacaggcagaacaccacggcagccgccgccagcgagccggtgacggacgaatcgaacagcagccgcacgagcagcacgaacagtccggcgccgctgagcaccgcaccgatgaaatgagagtaactggaaaacggctcacgggccttgagaaatgcacgaggcatacaaactcctcctcttgttatgtagagttaaaaactatatcatatctgttatgataccatatttttcgggaattgcaagtgctttctccaaattgtcaccatgaaaaaagcaccgtctttgttaatcaaagacggtgcttgggcaataccgcacaattaaagctgcggcgctttgcggaaattttatgccctgactttgttgtgattttgcggtaatacatcaagtattaccgcaaaaccacgcctcgtcagttcgtaaaatttactcgcaaatcgctcttgcttaattatgcggtactgcccttgaaaaatcaggtatacgatttcggaatttttatggttctctcctgcgcgggaaggtgccgggcgacttcctgccggattttctcattcttgatcatggtcggcatgtgcgcccgcacggtaatatcgtgcgaggcgttcgggttcgccggaagaatatcgctcagtttggtgtccatcgtgatgcggtaacgcggcagatcggtcaatccgcgccggatagacgccgttccggtgttggtcagtacgctgacctggataccgtttttctgcagcagcggctgcatccacccgtcgcgcgcgccgaacggatatgcgaaaaacagcacgtttttctggctggtattttgcgtgatgaggtcgatgctctgcttgaggtcctcaccgacgcgcttgttatatgccgcctgcgactcgcccttcagccgctggatgccgttgatgccgtccggtgcggtcagtccgccgtactgcgggttgtgcaggttgtaggtgtgagaggccagctccaccagaccgctgtcggccatttcggctgcctcatcccacttgaggaaaaagcggttcgcttccgtgttgtcgtttgcgcggatgcttttgccgatcagtgcaatgacggccttcatgccggttttctgcagaatcgggtacgcaatatcgtaattggagcgataaccgtcgtcaaaggtgatcatgaccggccgctcgggcatggcttcctttccggctcggatgtcgatcaaatccgccgagagcagcggcgtgtagccgttgtattccagatattccatgtcctcctgaaaccgctcgccggtgatggtcatgctcgtcacggcggacgggtcgttcgtcaggttgtggtacatcagaatcggaaccttcgaggcagtatttgccgcgctgcagctaatgcaggatacaaaaaatgcacctgtcagtccgaaaaggaccaggcgttgccagaattttttcatatgtaagcctcctaccgtttattgttcgttcagtataccatattacagtgggtttgtcgagcggtataactcttgcgtgaagcgcgcaaaaggcttataataatagcattgcaggccgcacgggcagacgaaaaattgcgtgtttccgttcggtactgtagttgcaaggtaacaccgcataattgaacaagagcgatttacgagtaaattttgcgttctgacgaggcgtgagtttgcggtaatacttgatgtattaccgtgaactcacaacgaagtcagggcacaaaatttccgtaaagcgccgtagctttaattgtgcggtgttgcctcgatattttgtaaaagatgaggtgaacgccatgccgcggctggagaaaaccatagaagcggtctttgccgaccgcgatatcatgcccgacgaggtgccgcagcttgacctgtatatggatcaggtgctgacgctgttcgatcagtgcttatcgggcagcaagcgcacgccggaggataagctgctgacaaaaaccatggtcaacaactacgtcaaggaagggcttatgacgccggtgaagggcaaaaaatacacgcgccagcagatcatgcagctgctctgcgtgtaccatttgaagcagacgctgcgcttaaacgatgtgaaggcgctgaccggtcgggacgatgtggactttgcggcgtgctacgagcatctgctcgcggacaagaagcgcatgcgcgaagccattccgccgctgctgaccgcccagctgcccgagacgccggatgacccggaggagcggctgtgcacatgccttgcgctcagcgaaattgcaaattatttacgtcggctgtgcgaaagcatgatcgacgatatcccgcagcagacagaaggagattgagacccatgtccatcgaaaaagcaaaagcgtatctgcgtcagttcggtgcagaggatcgcgtgatcgaattcccggtgtccagcgcgaccgtagagctggccgccgaagccgcccactgcgaaccggcacgcatcgcaaaaacgctgtcgttccgcacgaatgacggcgtgatcctcatcgttgcggcaggcgacaccaagatcgacaacccgaagtacaaggcgcggttcggctgcaaggcacggatgctcgcgtttgaggaggtcgagccggagatcggtcatgcggtcggcggcgtgtgcccgttcggcgtgaacgacggcgtaacggtctatctcgatgaatcgctccgacggttcgagacggtattcccggcgtgcggctcgtccaactcagccatcgaggtcaccatcccggaactggagaaattctccggtttcaaggcatgggtggacatctgcaagggctggagagaggcgtgagcacggttgccatcgggcagttcggcgccggggaggacaaaactgccaatctcaggggaatagaatgccttgcacaaacggcggcgaaaaatggagcgaaaatgctatttttgccggaatacagcatgtattacgcaaaagtgaacgcacggtcgaaaaatatcgaggccgcagagccgtgtgacggcgcgttcattattgcgctcggtgagctttgccggagatacggcctgtggattgccgcaggcatgtacgagcgcacggacggtctgccgtacaacacgattgcggttcttgacgaccgcggccgcctgcgcggaacgcaccgcaagaaccgtttgtacgatgccttcggctatcgggaatccgatgagtgccgggcaggggacaagccgttttcgcccatcgagacacctgtcggaaaactgggcatcattacctgtttcgagcttcggtttccggcgcttgccgccgagcagaaggcgcgcggtgccgagacgctgttcgttccggcgggctgggtgcagggcgagaacaagctgctgcactggcgcaccctgctgtgcgcgcgagccatcgagaacggcctgaccgtgctcggcgcagaccagtatgcgcccggaaaatttgtcgggcacagcatggcgtttcagccggacggcaccgcgctcggtgaactcggggaagaacaggatttgcttatcgtgaaaataaattgatgaaaattaacatgcggtgaaaggggagagggaatgaaggctgcaaagtttttcagcatctgtgaaatcgtttgctttgtcggtctggcgctgtcgtatgcaggcgaatttctgtgcgcttttgtggcgcaaggaacggataaggatatatttcagatgggattattcctgttctggctgcttattgggccgttggcaatctgcaatctgatttgcgctgctgtgatgtacaggcggctgtccgacccggcggtgcggcagacgctgtggcgctgcatcattgcaatgaagtgcatcgcgattccaatgttcctgctgaatttctttttcggcatgatttacggcatgtttacgctgattttcccgatgacgctgccggtcgtgctcttacaaatgctggttgcctggtttgccatgatggcctcgtccggctactgcattgcgctcatcctgcacgcgcgcaggcagggcaaaatcagcaccggaaccgcagtcctgcaggtcatttcccagtttatttacgttgttgatgttatcagcctgtttttcattcgcaagacggtaaaagaatgcaaaacggcacaataagtttaaaaaaggagtattatcatgcagtttgatcctacattatatgtcgttacggacagtacctaccacacgaccgagaccctgctccgcgcggtggacgaggcgtgcaggggcggtgcaacgctcattcagctccgcgagaaagacaccggcggacgcagctaccttgagctggcgcagcaggtcaagtccgtcaccgaccgctacagcgtgccgctcatcatcgacgaccgtgtggatgttgccattgcctgcgatgcagccggcgtacatgtcggcgcgagcgacctgccggtggcggtctgccgcaggctgctcggcccggataagatcgtcggcgcgaccgccaagacggtcgaagcagccgttgccgcgtacaacgacggcgcggactacctcggcaccggcgccatttacccgacgactacccacgttaccaccaaggttacgccggtctccgtgctgaacgatgtgtgccgcgcggtcccgattccggtggttgccatcggcggcctgaacgcggataatatggacgtgctggctgacagccccatcaagggcatcgccgtggtctctgccgttatgaaggcggacgatccgtgcgcggctgccgcgcatatcaaggaaaagttcctgaaaatgatgaataagtaagaaaaagctccgaaacaggcgtttcggagctttccttttgcaggtcagttgtttggctcgatcgcgtaatcgtagacctcgtgtccgctttcgagcaccttgccgtccacggtgatgagcactgcggttgcgccgcgcgcctgcgcgaacgtgttgaccagtgcgtagatcttgagcgtttcaccggcggtgccggaggcgcggatcgcctcgccgaaggcggcattcatgtcgagcgtgagcgtgccgttctcgagtgacgaggactgcaccttgacgccctcgggcagagagcctgcggcgatgagtgcgtccacgagcgactggtcggagtcgtccttcgcgtctgcgccggtcggcgtgagcgtttcgccctgttcatccggaacgtagatcgtgaccgactccgtgccgctcggattggggttttccggctgtacggcaggtttatcggtcttggaatcggacggtttgccggaattgctgtcgtccggcgtttccggcgtggtcgggttctccggctcggtaacagcaggcttttccggctcatcggcgggcttgctgcggacatatccatatacacaggctgcggcgactactgcaatgatcgcaattacggctgtaataacttttgagcgtttcattgtaaacgcctcctttcttttacaagcctattgtatcaagccggacgggaaaatacaagggatataccgttaacaaacggcggctttttgccctggtttgggcggcagtttttttcagcaccggctgagcgggatgcccgaactgcgtcagcgtgttcgcccctaacgggcggcagtctttttcgctgaacctcagcggggagttgcgctctgcggagcgcggggattcgccgcgccccgcggcggggcaagagggtagacaccaaggtttcttactccgaattttgaagcattttcggtttcagcaatcttgtggattctgacacttataaatgcatataaaacgcattttgtagtcaataattcaaaatcatgttacaaaatgtgaaaaacattgtttttctggttcgcgtagtttcatactgctttagaggtgttcgaaccgaaaacattggtgtaatcatggtgtcaatcagcggcaggcaacaacagctaacaaacatggcaacagcacgctttacagcgtgctgtttactatataccggttctatgcgcattggcgccgtccgtgcggcggcgtgcagcgcgtaagccgacggcacggaacggtgccgagggcgcggcgacagccgcgcccgaaatatagataccccctttatctaacaggggggtacaaatcggaatagatcagcgaatttcgcaaaactttgaacattaaaggtgaataaagcaagattttgcttgcatattatgcaaaagtattggtgttttctcgaaacaagcgcatagtggaatatattggttaattgtcgatggaataaaaaacgagagcgtatagcttgaaattgctatacgctctttttatgaccttgcaattttaagtcggttgaagtggttctttcacacatatcgcaaatttctcaaattcatacaatttgcagatacatgaatttacacattcccacggaatttaattgttatatccgtcatattcatgcgctccttaggaaactggtgccgctcgagatagtcatacagcagacgaatcggcaacgtgccctgcgttttcacgtcctgtccgatgatgaaatccacggtgccctttttcaccatgcgcacgttgccatctgtgatatcgtgcacgaccacatgaatcttttcgctgcgctcgtccgcaccggcgttgaccgcacggtaaaccccttcgcggcccgctgaggtcaggtaaatgcctcgcagagagctgtccgactggatagcgcgcgccgcgatacgttcggcaaggctttcatccagaaacgaacattctggatgcagaacgcggatattagggaaattttccgccatttccgcccagaatccggtgtagcgctgcgaatccgcatagtgaccgctgcgctgaccgagaatcggcagaacgctgccgtgtccctgcatgaccatacccatcagcgccgctgcggcgcgtccggcggcgatgttgtccggcccaacataggcaatgcggttcgcgtccgcaatatccgtgttgaaggtcacgaccggaatacccattttctcgctcaggtcgttgattcggtcgcgtacgagcgtattcgccagcggcataagtgccagtccgtcgatatgctcgctcgttaccagctcgtcaatcagagtcagctggtgctggatatccatatcgtacatcgaacgcacaatcaccgtaacattcggaatgagttcgcgttcggagaagctggcaaacaggtcgcacagcatccgcacaaacatggaatgtgatgagtgcagcaccacgccaatcttccattggcgggtctgctgcatgaccagccggttggagatgtaacccatttcacgggcagtcgcgcggatgcgctctgcgacttcctcacgcacgccctctttgtggtgcagagcacggtctaccgtgccgcgcgatacaccgcagcggtctgcaatctgctgcatcgttaccataaaatcactctcctgcgttatctgtacttatactatatcacatatctcgcccgtgcaccagatgttacatgtgcacgaaaatgatgtgccgtacattctagatattacaatgatagcggtatttttgtgcgatatatctataaacatccggcaatatatgtacatattcacgagataatgcacggacaaatgatagtgcgcccgagctattgcaaccgaaaatctgctgtgctatcctgtgattgtcaagtgaacaaggccgttcacgaaaccaaaaaattcccccaaagagagtgagagaaacaaaatgtcatttttcagttccatgatctggatcgcgctgagcttcctgtttttcaccgtcatggtggcagtcatttcagcgtggaagaccagagatgacaagctcgacaccgccgagggatacttcctcgcggggcgcggactgccgggcattgtcattgcgggctcgctgctgctgaccaacctgtccgcagaacagcttgtcggcacaaacggtcagggctgggcttccaacatgagcccgatcggctgggaggtcggtgcactgttcacgctgtttgcgctggcgctgtggttcctgccgacctaccttaaaatgggcacgaccaccatcccacagctgatggaagcacgcttcggccgcggcaccaagctgatgttctcgttcgtcatcgtcgtgatgtactccatcctcaatctgccggtcatcctttactccggtgcagttgtatttgagaatatcttcgatatttccggtatcttcggcatcagcaagttcacagcagttgcgattttgtgtgtcgtcatcggcattatcggcggctgctacgccatcttcggcggtttgaaggcggttgccgtatccgacaccatcaacggtatcggcctcatcatcggcggcctgatgatcccgttcctcgcgctggcgctgctgggtcacgaaaccaccggcggcggtctggtagagggggtcaagtaccttgtacaaaccgaacccgaaaagctcaacgcatgggcttcgtgggatgctgctgaaccggctctgccgtggccgctcatcttcacgggtatgttcttcaacaacctgtactggtggtgcacgaatcagtcctttgtacagcgcgcactcgccgcaaagagcctgaaggaaggccagaaaggcgcgatctactgcggcttcctcaagaccatcggcttcttctatctggtgctgccgggcgttatcgcttaccatctgccgtccattcaggacaagctggcggcggccggttcctccgcgatcgacttcgcttatccggcactggtttccgccgttgttcccaagccggtcatgggcttcttcgccgctgtgctgttcggcgcgatcctgtcctcgttcaattcggtgctcaactccgcatcgaccatgtttaccctcgacctgtaccgcactgccatcaatccgaaggcttcggatatgcagtgtgtcaaggtcggcaagatctacggcacctgcgccggtgcaatcgctatctgcgtggcaccgttcgttatgttcgcacagggcatcacgaccttcctcaactccatgagtcagttcgtttccctgccgattctgttcaccgtactcggtgcgctcatcttccgcaaggcgccgaagtacgtacccaaggtcatcactgctgttcacgttatcgcttacggcgcatttatgatcatcaagccctgttatcccacctcgggtgagccgattcattatctgtacgccatcgctgtgctgttcgtcgttgaatttgccatcatgtggtatctgaacaaatatcacggcacagaggaatatgttccggcggatgtcggcgcagtcgatctgaccccgtggaagtatcgccatatcgtatgtatcattggtatcattctggcgatcggcatttacattctgttttcgcccatcggtattgccgcatgagtaaaataaagtctaaccaaaaacctaattgagaaaagaaaaggagaacaattaccatgaaacttggatttaatgaagcaaatgaccgtttctgcaagaaccacagtgttatgatggacctcgagctgtgcgagaagtacggcttcgactgcattgacattcagtcggagtgcctgaaccgcgatctggaagccggcaagatcaccctcgaggagatgggcgcatggttccagagccaccacctcaagatgctctcctacaatgcgctgtgcttcttcaacatgaagcaaacgcaggaggaaaaggacgccgtgatggctgagctggacgagatcatccgccgctgcaacatcctcggctgcaagatgatcgttgtcgtaccgagcaaggacatgaaggagcgcggtctgaccccgacccgcaaggaaatccgcgaggatgcagttgccgttctcaaggaaatggtcaagaagtgtgagccgcacggtatccgtctgagcctcgagttctgcggcgagccgtccatgaccatcaaccgtttcgaggatgcttacgccatcgtcgaggaggtcaacagcccattggttggtgtaacgctcgatcagtaccacttctacgcaatgggctccggctgggacacgctcgaaaaggcagacggcaagaagattttcgtatggcacctgaacggcaccgaggatatgccctgcggcgcgtactacaacaacgacgagaagcgtctgtggccgggtgccgagggcgactgcctgccgcatgcacgctacgctgatacgctcaagaagatcggctttgacggcgactgctgcaccatcgagatcttccgtccggcatactatgagatgtcgcaggaggagaacgtaaagaagtccgcagaagtcacccgtgcacacgttgaaaaatacgcacagttctaatatcgtaaaatcagcagtatctcacagcatattccccagcatctatcacatttttttgatctgtaaaggagaatttattatgagctatctgaagaaaatcggcgcactgtttgtttcctccgcattgatggcatccatgctcgcaggctgcggctcgtcctccgattccaccggcggcaacggctctcaggctgagggcggcgatggcaattacaacatttccatcgtgttcaagaccacttcgaacgaatacacccagtacatgatggcaggcgctgaaaaagcggcggccgagaccggcgcggtgctcgacatgaagggcgcgacctccgaaaccgcatacgatgagcagcagaatatgatcgaaaccgatctgcacgccaacaagtatgacgcgatgattatcgcaccgctgcagggcgacatggcttccacgctggtaagcggcacggatatgcccatcttcgcaatcgacacggactttaatgcaccggagaagatttcgttcatcggcatcggccagaaggatgcagcggcaagcggcggcgaaaaggctgtcgaggcggcgaaggcagcaggctgggataagattgaagcagcttatattgcgggtgttcagggtgactccaccgccgatgcacgccgcaccggtttccaggaaggcattgacggcgcaggcggcacgttcctcgcggacgaggtgcagtatgcagacgccgtagcagataaggcaaccgtctgcatggaaggcatcatgcagagccatccggagggtctggctatcatcgcctgccacaacgacgactgcgcaattgcggcagctcgtgcagcagcgaacaatccggcttatgcaaagaccatcttcatcggctttgacggcaatattaccgcagcacagtccatcctcgatggcggcgagaccatgaccgttgcacagagcggttacgatcagggctatcaggcggttaagaccgttgtggcacatctgaacggcgaaaaggtagacagctttgttgactgcggtaccaaggtcatcgacagcaccaccgccgaggactacatggcaaccctcaagagccagatggacggcaaggcagttgcacagtaaaccgtaataccatgcgctgcacttgcagcagcaagtgcagcgtatctattaaacaatcacgtttctataaggagagaattccaatgggcattttgaaaattggcgttgtaggctgcggccgaatggtcgcgtttttcagttctactacgtattcactcatttgcatatcaccttttcttctccgagatgaagtgcgggacaaagtaaactgttctcggttcagttccctaaggaaaagcctgcccagtgcaagctctttaccatttcttgtccgcgggagcatgtttgaaaagagaacccctgcagagattaaaatcgagcaggggtttcttctcgttcacttaaatgctggaactaatggaaaaccacaagcgtgtgggatggattgcttagccgatgtagcccttcagcttatccaggcgctcctgagcgttatccttggtgacaacggagcagccggagtcgatgaacttctccagagtctcaccgttaacagcctttacagcagcctcaactgccttgtagcccatgtcgtatgcttcctgagcaacggacatggtctcctcaccagcgaggatagcgttgcaagcggactgaatgccgtcgaagccaacgaagatggtcttcgcgtaagcagcgttgccctttgcagcacgagcagcagccatagccatatcgtcgttgttgcagacgatgatagcgacgccttccggatggttctgcatgattgcttccatcgaggtagcagccttatcagcaacagcgtcagcgtactggatctcgtccttcaggaactcgccgccagcctcggtaacgcccttctcataaccggtcagacgtgcggtagcagtgccgtcgccctgtacgccggaaattgcgattgcctgaaccttatcccagccagcagccttagcagcctctacggcagccttgccgccttctgcagcagcatcctcgttgccggtacctacgaaggacagaacctcaggtgcatcgatgttggtatcaactgcaacgatcggtgcggtctggccagcgatcagggtcttaacgaggtcagcctgcagcggagcgataacgaatgcatcgtatgcgccggagttcaggtcggtctcgatcatattctgctgctcgtcgtaagcggtctcggaggtagcgcccttaacctcaacctttacgtccgggttgtccttggagtaagcctcagcgccagccttaacgtagctccagtactcggaagcagtcgtcttcaggataacgtcaacagagcagccggaagtggtgctagccttaccgccgccatccttctgggtgtcgtcagccggggtagaagaaccgccgccgcaagctgcaaggcttgcaaccatagcgccagtcatcagcatagcaagtaatctcttcttcatgataaaaacctctctcctttttcatgcggagcaaacagactctcaggttgtctgctctgcggtcggttcccactgctgtgggacttaggaacgctccaacgttctggtaatattttaatgcaataataccgttttggcaacccttcgttgttatttttgtaagaggtggtgattttcgcatgtttcgttttgtgcacattcacaaattcctgctttaacaatcgaaaaccagacactgtgcattgtgcatttttatttttcttacggcatttttcctataaaatcatgggaatttcatggtcgttttgggcacattttggagacatctcttgccagcaaaggttacaatgtggtaaaattaccgtatcctaatgagagaaggaatatgacaatgaagcttgctatcaaaacctgcacgctggatatgccctatgagcagatgctcgacttctgcgtggagcagaaaattgccgccattgaaatcggcaccggcaactggtcgagtgcgccgcactgtgatctcgaccttctggtaagcgacaagaccgcccgcgaaaaatggtacgatgccatgcgtaagaagggtctggagctgtgcgcgctcaactgctcgggcaacccgctcgcgtatgaaaaggacatggatgtaacaaagaaaacctttgagctggcgcatcagctcggagtaaagaagatcgttatgatgagcggtctgccggtcggctgcgagggcgataaaacgccggtgtggatcacgacctcgtggccgcccgagacgcaggacattctggattaccagtggaatcaggttgcgattcccgcatggaaaaagctcgttaagctggcagaggattgcggaatcgagcggattgcgctcgaaaaccacggtatgcagctggtttacaacccggaaacgctgctccgtctgcgtgaggctgtcggcccgatgatcggcatgaaccttgatccgtcccacctgttctggatgggcggcgatccgatcgaagcagcccgtgtgctcggtgagcacggtgcaatttaccatatccacggcaaggattcacggccggagcgccgctactggcagccaaacggcatgctggataccaagccgatcgacgcatttgcccgccgctcgtggaactatgttgccgtcggcgcgggacacgatgccaagtggtggaaggagtttttctcggttgtccgcatgtcgggctacaacgatgagatttcccttgaaatggaagatttgacgctctccatgctcgacggtcatctcgccagcctgcaggtgctgcgcgaagcgctcaacatcgactaaacgctccatatagaaagaacacaggcaccgctgctctctctgcgatgcctgtgttctttattttatgaagttctgcgttatctttctttaagagccacatacggctcggcgggctgcacgcagcggtacgccgggcggatgatcttatccgtgttgatcagctcctccaggcgatgcgcgctccagccgacgatacgcgccatggcaaacaccggcgtgtacaattccggcggcaaacccagcatggaatacacaaaacctgagtaaaaatcaacatttgcagacacgcccttatagatgtggcgttcctgtgcgataaccttgggtgccatctcctcgaccatggtgtacagcgcgaaatctgcgtctctgcccttctcgtgcgccagctgaccgacgaaggatttgaacacctgcgcacgcgggtccgatatcgagtacacagcgtggcccatgccgtagatgagtcccttctggtcaaatgcctcgcggcgcagcagcttgacaagatagtccgcgactgcctgctcatccgtggtgtccgacacgtttttcttcatatcctcgaacatctgcacgaccttgtagtttgctccgccgtgtttcgggcctttcagcgaaccgagcgccgctgcaatagccgaataggtatccgtgccggaggacgtgacgacgtgtgttgtgaatgacgagttattgccgccgccgtgctccatgtgcagtacaagcgccagatcgagcactcttgcctcgagcggcgtgtactgcatatccgggcgcagcatgcgcagaaagttggacgcagtagacagactgtccgacgggtagtgaatgtacatgctgccgccgcactcgtagtgattgtaggcgtgataggaatacaccgccagcatcggaaagaccgaaatcagcatcaggcactgccgcagcacgttgggcaggctgatatcatccgcattgctgtcgtaggatgccagcgtgagcacactgcgcgacaggctgttcatcatgtcgcgggtcggtgctttcatgatgacatcgcgggtgaaattggtcggcagcgtgcggccctgtgccagcagcgccttgaagtcgcccagccgctttgcatccggcagctcgccgaacaggagcaggtacgcagcttcctcgtagcccttgcggccgtcccgaacaaagccctgcaccagatcctgaatgcgaatgccgcgatagtacagctcgccctcacagggcacgatttcgccgcctatctccttgcgggagataatgtccgaaatgttggtcagaccggccagtacgccctgtccattgatgtcgcgcagaccgcgcttgacatcgtacttgcggtacagcgccggatcaatgcggctgttcgagcggcagagcgccgccagcgcttccacgcgcggcgtgacctgtaaaatatcgtgttccggtgtcatgatgattcctccctttgactgcattgtgtgatatatttattgtatcagaatccactcgcgtttacatgacattttttgcacagttccgttaacaattcgtgaattttttcgcacatttcagcagttacacaggatatgcccaccaatttgataaatttatgcacaaaaaggcacaatgagtttctcattgtgccttttggaactctgcaatttttgtttagcggataaccatacggatcagcggataaagttcatcatcgtgcgcgggtggctttccggcggctcgattccggccttgtcgatcaccttgagcatccatgcgatgttgcggcccagcttctcgatgacttcaacgccctcgatatcctgcacagcctcgcccttgtctgcgccgtgtacggcgttccagtagtccgaggtgacaagcaccatctccatggtgttgatcgtgccgagcagctgctggtaggtctccatgccgcccgaacggcgcagcgtacacagcgccgcaccgaccttgtgcttcagctgattatcgccgcagcctgccgccagaatcagacggtcgagcacgcacttcataccgcccgcaatgccgccgtggtacaccggagacgcgagcacgatgccgtccgcctcaatgcacttggcgatgatttcatttacaccgtcgtcgtcctgcacgcagcgcagcgtgccgttgtccaggcagtgatagcacgccatgcacggatgcaccttcgcccccggctgacatacctcaaactcgatgccctcctgctcgagcaccttgccgagcacctcgagcatctgcgcacagttgccgtccttgcgcggcgagccgttgattgctacaactttcatatccttttcctccgtgttttctctattttcagtgcgtatccgcactgtttttacttagatgtgtttctcgttttccagccggtacagccgcatcacgaccagcgtatgattcagctgcggccccatcagcaggatcatgctgacgatatacagccacagcatcagtacgataatcgccgccagagagccgtacagcacagaataccgcgccatattgtccacatagaacgaaaatccaagcgataccagaatccacgctaccagcgagaacagcgcccctggccacacctcacggaacctaaggtgcagattgggcacgaccttgttgaacagcatgaggaacacgaaaataaacgcgatcatcacccagaagctggcatcgtgcagtccgtccatcacagccggcggcaccggcagatatttcggtacaacgcggatgatggttcgtccggcgacaacgagcacaaagctgcacacaaccgaaacaagaaaacccgccgtaataccgaacgaaatgagcacgtccttgaccatgccgcgcgagatttcaacgtggtaaatatcgttgaccgtgcgcatcattgagcgcaccgcacgggacaggaaatacagcgtcagacccagaccgacgatcatcgggctgaacgacggcgtgccggtcagctgctgaatatagccgcctatgagctgctgcaggcttttcggcagcatttccagcaccggctgcatcccctcgattgacaggtcaagctgtgcgagcatggagttgacgaacatcagcagcgggaacatggaaaacagcagaaaatacgaaagctctgccgcagactgcggaatgccgtcatcaaaaaagcggtaaaccatgcgcttgatcagatatagccatcggttttgaccgttcattgcgtccctcccctgtgtcggtaaattgtgctgtacttatcatatcagctttttatcaaatttacaacttgcgttttggcttcatctattgtatactgataaaaacagaacatttgttctgattggagggtgtgtcatggcggatctgcgtccggtgacctgctgtttttccggctaccgaattgaaaaaatgccgttccggaacgaggactgtcccgctgcgcgcgagctgttcgccgcactcgatgctgcggtcgcagaggccgccgctgacggctgtacgcggtttctctccggtatgtccaccggctttgatctgtgggccgccgaagctgttctgcgtgcgcgcgccgcactcccggtgcagctgctgtgtgttgtgccgttcgacggacaggccgatcggtttccgctcgagtggaaacgccgattcaaccgctgcctgctcgctgcagataaggtgtacgcgctctcgcggagctatcacgccgggtgctttgccgcgcgcaaccggtttatggtggatgcatcgtcaaggctcatctgttactatgatggacggtcgggcggtacggcgcagaccgtgcgcctggcacggcagaacgggctgacgatcgtaaatctcgcggacgggcagctttcgctgctgtaaaaaggactgaccgagacgggcagtccttttgttttgcatttgtttgcgtatgtgttctctgtagaacggcgggtgatctcaccccgccgtttctctctaaattgcaccgattttactcagctatacacagcatcgtaggggcgcaccaatgtgtgcgccctaagcgaaccgccacctatgaaaaagggcggacacattggtctgcccctacggtaatctgttcaggtagattgcatcacggcattgctgttacgaattgcagatttcatccagctgagtaagaatctcactgccgtttttcaaatcatgcacccagccgttgccgttgtacacaaaattaagttcaccgatattaaggaaggtcgacgtatcattatacaccgcgatgatttcgtagctgaccttatccatcgaaaagctgctctgcgaacgcggcacacgtttggcctgcacctgtgtcagcgcttcgcgcagagccgtttgatcgacctgctcggtcagttcggtcatatccgcgccattgacgcgccagatacgcacgttccagaagccgtccatgtccggcataggtgcatacggaataagccaaatcgccgctccaacgcacaccagtatgcccgctaatgcaaatgcgattcgttttttcatgtcggttcctcccttttattgtttatcaagcagcgcaagaagtttctcgctgccggacagcttatgcacccacggtgacatactttctgtgacctcatacgcataactcggttcaccgaggctgaaacatacggttttaccgccgtataccacctgaatctgatagcagtcttcgctgatgccacgatgataactcggcagacggcgcgctctgatttgcggcagcagttcgcatacggcgttcgtatcgacctgcccggtgatgtcctcagccgtatctcccgcatgaacatggagtaccagcacgtccacaatctctgctgtatccggcactggcgtatacgatgtaaagcacgatgccgctccaacgcaaaccaaaacggctatcaaaacaaatacaattcgtcgtttcatgtcggttcctcccttttattgtttatcaagcagtgcgaggctttccccttgggcggctccagagaaccttctcttaccctacgggcaattcaccttgtgccgcccactgcgttgactttccgatatgtgtagcagtacgctatccgagaactgcgaatattttgagaaacaaacgctgatgtaacccgactgtcgttctccttctcgaagcggtcgccgctctaccattttcgccagactatctaacaagggaaacgggagtcccaagagggtagaaaccgtaggtgtctacccttttggtttccgcggcgaaaccgccgccgttccccctgctttatcaagcagaaaatttttcctgtcgaaaaagcaaaatccgccgacgcgattgaattttcacgtcggcggattccttacttatgcaattatgtgtgtgctgaaattacttcaggccagcggtgatgatcgccatctggtaaacctcgtcagcgttgcagccgcgggacagatcgttgatcggcgcattcagaccctgcagaatcgggccgtaagcagcgtagccgcccagacgctgagcgatcttgtagccgatgttgccagcctcgatagacggaaagatgaaggtgttagcctggcctgcaaccggagagcccttgcacttggtagcagcaacaaccggggatacagcagcgtcaaactgcagctcgccgtcgatcgccagctccgggttcatctccttagcgtactcggtagcctcgcgggacagagcaaccgtgccgcccttgccggagcccttggtggagaaggacagaacagcaaccttcgggtcgatgccgaaagccttagcggtgtttgcagtctcgattgcaacctcagccagcttctggctgcccttcagggttacgttgccttccttatcaacagaatccggatagtcgatgttgatcgcgcagtcgcccatagccagcttctcctctacgccgtccttctcacggaccagaataaagcaggagcttacgaggtgtgcgcccggcttggtcttaatcagctgcagagccggacgaacggtgtcagcggtggagtaggtagcgccgccgagcagagcgtcagccttgcccatcttaacgagcatggtgccgaagtagttgcccttagacagtgcagcgcggcagtcttcctcgctcatcttgcccttgcggagttctaccatcttagctaccatagcgtccatctccgggtaggtagccgggtcgatgatctccatgccctcgatatcgaagccgccctttgcagcagcagcctttacctcgtcaacattgccgaccaggatggaatccatcaggccgtccttcttcaggcgtgcagccgcttcgaggatacgagcgtccgggccttcggtgaatacgatcttgcgcttgtcagccttgagtgctgcaatcagattttcaaacatattgcattctccttcgttttcaatcgcctgtgtgcagtgtgacgctgcaaacaggcattctcttgaatttattatacacccttcccccctattcccacaagagggaatttctgatggacgcaaaacgctttctcggttccatatcacaaggcgaacgtgaaatttgtcgaatctccggcccatgcaaaatatttcgtcggtatatttgaacgggaccgcggggaaaatccagatagtatcctcatagtgacgaccaacaggagggaattttatgcagacaaaagttgagatctgcggtgtgaatacatcgggactgccggtgctctccgcaaaaaagacggacgagcttttgaaaaaatccgctgccggagacaagcaggcacgcgatgaactgatccgcggcaatctgcggctggtgctcagcgttgttcagcggtttcagggccgcggcgaatcgccggacgacctgtttcaggtcgggtgcatcggcctgatgaaagccatcgacaattttaataccgaactcggcgtgcgcttctccacctacgccgtaccgatgatcatcggcgaaatccgccgctacctgcgcgacaacagtgccatgcgggtctcgcgcagcctgcgcgacacggcgtaccgcgctctgcaggccaaggaggcgttcatccgcgagcaccagcgtgagccggacatcgtggaactggccaggctgatggacgtgccgaaagaggaggtcgtgttcgcgctcgacgcgatactcgacccggtgtcgctgtttgagccggtgttccacgatggcacggacacggtctgcgtgatggatcaggtcggcgacaccaaaaacacggacgacaactggctggccggtattgctctgcgggacgctatgcgcagcctgaacgaccgcgagcgccgtatcatccggctgcggttctttgagggacgcacccagatggaggtggcacgcgaaatacacctttcgccaaacaaaaggaaggaagattccgatccttttcttactatatataatgtacgagcggcagaaaacgcgaggataggtgcaaacggtttgcgcctatccccatctgaatatccacacaatatttgacgcttcaaacaggatatctcatggctattgatagattgatccgctctcttccgaatgcaatggcatcaagttcattcacaaggcgctcaaccacttatgacagcggttgagcgtctcagtctgtccagaacctttgttattgcagcatatcccgcttgattttcccaatccgcatataataccataccagattgagcgctgccgcacacacccatgctgcgccttccgcaaagaatacgccgctctgcccgatgaaggtcggcagcacgagcgccgcgcccatgcgcatgagcatttccgcaaagccggaaagcgtcggcacagtcatctcgcccaacccctgcagtgaggagcggtatgcctgcagcatgaacagtgcaaacaaaaacgccatcagcaccatgagatactgataggccaccgccagcgcatctgccgcgcccgcctcctcggtcgaaagaaacagtcccagcagcggtttgcccgcaacaagcatagccgtcacgatggcggctgtaaattcggcggacagcaccagtaccgcccgaatgcctgcatcaatgcgtgccgcgtttcgtgcaccgcggttctgccccatgtaggctgtcatggcatagccaaacgccactgatgcactttcgagtataccgtacagcttgttggccgccgtatagcccgccacgaacactacgccgaagccgttcagcacggactgcagcaccatgcctcccagtgtgatcatgctcatctgcaggccggtcggaatgccgaggcggcacaggtgcagcagaatggcagggtcggttttccagtcggcctttgtcagctgcacgaacggcagccgccgcagagaacgcagacaaagcagaaacgcaatcaactgcgccagcacggttgcgaacgaagctccgaaaatgccccagccaaagcccatcacaaacagcaggtcgagcgcaatattagcaaagctcgccgcgataatcgcaaacagcggtgttctgctgtcgcccagacagcgcagcacggccgccgccatgttgtacgcaatgatgatgagcgagccgccgaactgcacatataagtatgtctgtgctccgccgaacactgcaggatcggtgtgcagcagtgtgagcagaggtcttaccagcagcagactgatgatcgtcaccgcaatgccgaaccagcacgacagcttaacgatcatagccagtacacgacgcagccggtcgtatgcgcccgcgccgaactcctgcgccgcgagaatcgcaaagccctgcgtaaagccctgcagtccccataaaaccagccagttgatccaatccgccgcaccgatggacgccagcgcctgcatgccgacaccgcgtccgatgatgatcgtatccacgatggtatacagctgctgaaacacgctgcccagcatcagcggcagcgaaaacagcagaatcagccgtatcggacgaccgtgtgtcatatcggtaacgcgcaccatatcgcacctcccttgcgaaaaatcataaaacccaaagcgcagaaggagacggaactgcacttcgggtttcaaaacgacggtaccgcagaatgctgttgatttaccgcacggtaagataaaacacggtaccgccgccgttatgatcaggaatcagagaaaatcgccgcacaggctgagagctgcctcatctgcgataacgatcgcgtcgttgtgcagctgaagaatcgaaccgggcaccttgggcgttaccggaccaaagcaggattcacggatagcccacgccttgtcctcgccgctggcaacgaccagcactttttttgcggtcatgatggtgtgaatgcccatcgagtaggcacggcgcggcacctcatcctcgctggcgaaaaagcgcttgtttgcctcgatggtggactcggtcagctccacgcagtgcgtgcccttggcgaagcagttgtccggctcgttgaagccgatatggccgttgcggccgataccgagcagctgaatatccacatcgcccacactgcgaagcaccgcatcatagcgggcgcactcctttttctcgtccggctccatgccgttcggcagattgatacgcgatgggtcgatgttcacatggtcaaaaaagtggtcgtgcatgaaataatgatagctctggtcgttttccggcttcatgccgtagtattcatccagattgaccgtagtcacatccgcaaaatccagatcgcccttttcgtaccacttgaccagctgctcatatgtgccgatcggcgacgagccggtggcaagaccgagcacggaatccggcttgaggatgacctgcgcagaaatgatatttgccgccttgcggctcatgtccttataatcctttgcacgaatgattctcataacgaaaaagcctccaaacgtttataaatccttatacttttcacgcagcgcgagcagctcgctctcctgcacatactcggtcaggcagcctacgccggtaacactcttgccgcctgtgatgttgccgaaccgcacacaatccgcaaacggatagccgtggtacagaccgtacatcagtcctgcaaggaacgcatcgcctgcaccggtggaatccttacaggtgaattccggaatattgcgcagcagacgcggcctgccgtcctcgagaatgagacagccgtccttatccagcttgaccagcgggtgctcaaaatactcagccagtacgcggagcgcctcctccggcgtgtccctgccggtgatcttgagtgcttccttggtattcggcgtgtagtaatccgccaggcgcagataatcgccgtatttctcaaagctcagttcatcatcccatcccatgtcgaaaatcagaatggtgccttcctcgtgcagcttgcgatataccggcaaaaagccctcctgcatctgcaccagcttagcgcccttagacatggtatatacccgctcgagcagctcgtccgtgatggcggtcggcttgcagtaggtcgcaaatgtacggtcgccgggcgtgagcatggcactggtgacattcaccggaataccggtctcgccctccgccgccagattgtacggagaaacgccgttctgctcaaactgcgcgcgagcaaagccggaaaacagatcgctgccgagataggtcgccagacgggtcggaatgcccagccgggcggcgtttactgccgtacccggtgcaccgccgccgagcagcacgcggaaatcctgcgaaaagatctcctcgccctcctgcggcacgcgcggcatgccgacatacatcaaatccacattggtcacaccgaccgaagcgagaaacgacatgcgtcagtccctccagtccccgatatacggcgcgttgagcttgatatactcgtcggtcagcttgcttgccagcgagtaagagccgaccaacgggtgcatggtcaggcactcggtaatatcctttctggagcggttgacgataccgcgtgccgccagacgttcgtaatattttacgcggcggatcatttcgaggttgctctccggaatgttctcgatatggtgcggcttgcagccctcgcgggagatatcgcaggtaacttcgataatatcggtcggctcgaggccttcgatggcattgccgttcggtgcgcacaggatcatcgtgcccatgccgccggaggctgcaatctcgatgaacttgagcgcaacgcctgcgtagccgcccgcgtccttggaatacacatcaaacgtccacggcttgtcgcggtgaataccagtctcattggccatgtagttgttctcgcggatgccgtaccacttttcaaagcacttgagacccgcctcaaagtcgttctcgatgtcgatcttggacagctcctcggtcatgtggcggttgatgtcgcagatcatctcgccgcgcgtctgcttggcattcagaatgttggcaaccgccttttcacggtagtagaagtagtacagatattcattcagcacacagccgcggtcctcgagcagacgcttctcgaaaaagcgcatatcggtcttggcgtaagcctcgtcattggcgatcagctcgggcataatctcctttccgtccaccttgatgctctggaagtaggacagatgattcaaaccgtagcactcgccgtaaatgcgggacgcatccacgccgtacaggtcggcaaactggtgcagcatgccgctcggcgcgtcgcagataccgtaggtgaaatcatatcccatatcacgcagcgcctgtgaaaccacgcctgccggattggtaaagttgaacaccttgacgcccggctttgccagcttcttgatcagctcgcagtactcagccagcgccggaatcgagcgcatggcgaacgaaacgccggccgcacctgtggtctcctgaccgagaatacccagatcaagcgccagccgttcatcgcgcacgcgggtcgcatcgccgccgacacggatggtcgtgatgacgtaatccgcatcggttaccgcctcctccgcactggaggtcagcgtgaacttcatggtcgggcacagcatgcgcgcaacgtgcgccgccagaccgccgtagatgcggagcttttccggatcgttatccataaataccagctcgtcgatgtgcagctcctccgcacgctgtgcaatgctctttgcgaggaacatggagcgtacaccgccgccgccgattaccgttaatttcataaaaagatacctcctgttatcgaatcagataccgtttgcagctggaccagccaatcatgcccgaggcaaatccggacagaccgcacgggaacagcagcacatacggcagagaaagcgggaaaaacagcactgcaggaatcagcagcagcgcatttacgcccagccccagcacggtcatgccgggacggagcagacacagcagccacgcattttttgccgctgccgcaaacgggatgtccaccgccgcctgtactgcccagaaattctggaaaaacgcagccgtgacgcagagcagcagcatgcccagcagcgccgggaaaaatccgtccgccgttaccagcatcacgcccatccacagcagcgcaagctcggccagtccgcacagaagattgcgcaccgtatcctgccgcagcgccgcacggaaatcggtccacacgtcgttcggcacatcacgcgccatattgaccgtgcagcgcgccatggcggctcgagccgcaccgaaggtcacgaccggcagacagcacagcagaaacagtacattcagcttaacgatctgccagaactcccgcgcaagggtctctccgacccatgcagcgccggttttttccggtgcatccttggcaatgcccggaccttccttcaaataggatggacgaaacacagattttcctcctgtcagaacgcgatcgcgcgttcggtctgcttatcgaacaaatggatgcggctcatatccacagccgcggtaatggtgtcgcccgcatgaatcggctcaccggacggcgtacgcacggtaacggacgtaccgtcacaggtgcagtgcgcgtaaatctccgcgcccatcagctcggcaatatccacatgcatggtgagcgtatgcgccgcattctgcgtaaacttttcacccgaggtgtgcagattctccggacggatgccgaacacgaccgtctttccgacgtactcactcagcgcatcgctgcccgcaaagtgcaggctctgatccgcaaaggtcagcttgtagccgtccgcatcgcgtcccagttcggcgtccatgaaattcatctgcggcgagccgataaagcccgctacgaacagattgcacggatggtcatacagcgtctgcggtgtgtccgcctgctgaatctcgccgcccttcataacaacaatacggtcgcccatggtcatggcctcggtctggtcatgcgtaacgtaaacaaaggtcgtatccagcttctgatgcagcttgatgatctcggtgcgcatctgggtacgcagcttggcatccagattggacagcggctcatcgagcaggaataccgccgggtcgcgcaccatcgcacgtccgagtgcgacacgctgccgctggccgccggaaagctgcttgggcttgcggttgagcagatgctcgatatccagcaccttagccgcctcatgcaccttgcggtcgatctcgtccttaggtgtttttcgcagcttgagcgcgaatgccatgttcttgtaaaccgtcatatgcggatagagcgcgtagttctggaaaaccatcgcgatatcgcggtccttcggcgctacatcgttcaccttgcggtcaccgatgtacatttcgccgtccgaaatctcctccagacccgcgatcatgcgcagtgtggtcgatttgccgcagccggacggtccgaccagtacgacgaactccttatccttgatctgcaggttcaggtcggagataacctcgatatcaccggggtacaccttcttgatgtgattcaaactaatgcttgccatgtaatttcacctcgtttattctttgaccgaacccgcggtcaggctggaaacgacctgctcctggaagatcgcaaacacgatgatcgaaggaatgaccgcaatggtaactgcggcaaacagcgccgtgtagttaaagctgaactggctggtaaagtagctgagcgacagcggcagcgtgcgggcactctcgctgctggtcaggatcagggagaacgtaaattcgttccatgtattgaggaagcacagcacagctgcgctcgtaagaccgcccttggcgcacggcatcatgatctggaagaacgtgcgcaggaagcccgcaccgtcgatgtaggcggcctcctcaatggccttggggatagactggaaggcgccgcgcaggatgagcaggctcatcggcatattcagtgcggtgttgaccagaatcagacccgccttggtatcatacagacccagattgttgaccacgctgtacaccggctgcagcagtgccgtcatcggaatgacgagcgacaggctgagcagcatgtacagcagcttatcgcacggaaagcggaaccgcgcaaacgcgtagcctgccatagcgaagacgagcacattgagtacagtcgcgcagcaggtgacgatcacgctgttgccgaagaacttgaagatcggcgccatatccagtgcggatttatagccgtcaaacccgaagtgcgtcggcagcgaaatgccgttcgacaggatctccgcattcgtcttgaacgaggacaggatgacccagatgatcgggaacagcgcaacgaccacgcacagcgccataaacagatatttgagcacaaagcacaggcgttctctgccggtcattgcaccgaagctggttttcatttgtcgaacgcctccttagtagtcttcttcgttgacgcgcatcgccttgttgatgagcgtcatgcaaacgacacccgcgatgacgatgcaaacgccgatcgcattcgagtagccgtagttgttttcgttcttgtacacgctgtacagcatgagcggcaggttcatggtagtcgagccggggccgcccttggtggtgatgtagatcaggtcgaacatctgcagcatataggttgccgccatgaccatggtcgtaccgatgatcttgcgcagcagcggcagcacaacgaacatatcggtctggaacgaagtcgcaccgtccacacgggccgcttcgagcaccgaatcgtcaatggtcagcgcctcggcgagcacgagcgtcgtagtgtagcccgcaaacagcagccacgtcatggtgacggacgggaacgccgttgtggtatccatcagccagttatgcgtcaggctttccagaccgacagccttgaggatggaattgaccacgccgtactgcgggttgaaaatattgaggaagatcatgcccattgcggcgttggagatgatattcgggatcatgtatgccgtacggacaaatttccagccgcgcggctttttgtacagcacaagcgccaggataacgccgatggagacatgaataatacagtggatcagaatccagacgaccgtgtggccgcacgcctgccggaaggtcgcatcgctgaacagctgtgtatagttctgcagaccgatgaatgtcatcgagtcgcccgtcagccggtaatcaaacagcgaggaaacaaacacgatcaccagcggaacagcatagatcagcaggaacaatgcgacagccggaagcaggaacaccggcagccagccctttttacgtttcataaagcggtttcctttcttgttgaggagaaaaacagggacccgttttttgacgggtccctgcgttaaacagtttactggttcttcgctgcagcgtccgtcagcgtctggcagaagccctttgcgtccagctcacccgaagcgagcagcgggagctgctggctcataacgtcgagcaggttggcgtacatcgtagcctgcagagtatccgagcgcttttcgccctcagtggttgcaaggttaaggaactcagcaagcagcggatacttgtcctttgcggtgtcggtcagctctaccgtgttggaggccggaaccatgccctgcatctccattgcggtctgctgtgcctcagccgaggtaaagaacttgaccatctcaatggcagcctcttctaccttcgggtcgtcctgcttggtaacgatgtagccctgaatcggtgcatcgtatacgaagttgcccgggaacagcgctacgccgaccttatcagcaaagccttcctctgtcatggaggtatcagagaaatcaccgatcatccacgggccgtttgccagcattgcggtctggccggccaggaagttgtttgcagcattctcatacttgccgccgattgcatcctgcgtggtgtagttctggtacatcttctggatcttctcggctgctgcgatcatttccggcgtgttgtagtcggtcgggttcatggtgttcatgaactcaaggcctgcgtcggactcagtgccgaccatagcgcccatccacagctgggttacccacgcggaatctgcggtatccatggacagcggggtgatgccggctgccttcagcttgtcgcactgctggaagaactcgtcccaggtcttagccggctcggtgatgcctgccttcttaaacaggtccttgttgtagaagtaaccgataacctggccttccatcgaggaagcgtaaatcttgccgtcgcggctgttggtagccagcgcggtatccgaatacagtgccttccagtctgcatcggaatttaccgcatcggtcaggtcaactgccaggtccttggcaacgaccatatcaagcagattgtagccgccgccgtaaataaccggcgggagatcgcccgtgccaagctgtaccttgatcttgtcgatgtagttctggtcgcccggaacgtcttccttcttgatctcgtacttgcctgcgtacttctcattgaattccttaatcagttcatcgcataccggagcggacgtattcgtgccgcactggaacgtcggatagttgatggtgatcacaccggagttgtcaccgctctgtgcagaatcatccttcttgctgccacagccggtcagtgcaccggtcagcagcgcgcctgccatcagcagggagaggatacgctttgttttcatgtggggttcctcctctttctctccgtgcggcatttgtctcattcaaataccgctctgtgttttgttgtattcattatacccgaggaacagtctgccctcaatgcagtaaaccggtcaaaacatatgacgattttgcttttcgttcacacgctctgcactcctctttgaaaacataggattattttgcgctaaaacaggatatttttttctaatgtcgcttctccccctccggatggtacacaaagcggtcgaattgtggtatatttaggataactccgcagctctattatatggtgctgcccttgtatagttcgcagaagctcccgtgaggtgtattgtatggcaaaacgcaagatctctcttatcgggctggtcgttgtgatgatatgtgttctggtattcgcacctgttgtcaccgccggcatctattttattcataccgtatccggtcagctgcagcataccgccagtgagacggtttccatgtatctgaacgaattcaccgaccgcaccgaccgcatgatggagaccctgcgggatggtgtgtactacctgacctcagacagtgccgcccagcagatgatgagcagcagcaaaccgctcacccagatccagattctccagctggagcagaatttcagccgcacattctcgctcggcgattcgctcaaccccgatgtggtcagcgccatctacctgatcaaaaacgaccaatatgtgccggtctacggcggcaactactatttgaatacctcgtggcgcgtccggcagatgtaccagacgcacgaggactgcaactccgcacgcacgctgtacacgcactacgccatcattggatacgcatatatgatcgtcgattttgttgaccttaacaccatgcagccgcttggcaaaatcatcgtggagctgaacatcgacaagctgctctccacgctgtcgctgaaccagctttacccttccactgtcgtcattttcagcggtgctcagggcaaacgcatcggctctctgcagaccgatctgttccgcgagaacgaggatatgaacaagtggtatcatgcgtccagctcactccgaaaaagccgtgagcgcgtggacatctatattccaaacgccgaaatcctcgccggtgtgcgccagagtacgcgtgtgtattttctcgtctgtgctgccatcctgatcctggccctgctgctggccgccacctgtctcatcctgctgctgcgtcctctgcggcagatgctgcacaccatcggcagtatcggcagcggtgatttttccgtgcgcatggatgaaacgccatacaccgaaacgaccgctatctcgcatgccttcaacgatatggccgaccggctggacaccctgtttcaggaggtctatcagcgcggtctgctgctgcgcgatgcagagattcatcagctggagagccagattcagccgcacttcatctttaatattctcgagctgatcaatgtccgctgcatggtagccggtcagccggccatctgcaccacggtgcagaatctggcgcagctgctgcgggcaagcgttgtcaaccatggcaagcagattatcaccctgcaggaggagctggattcggtaaaatactatcttgccctgcaaaaggaacgctttgaggaaaagctgcagtataccgtcgatgtggaggacgacaagctgctcggctgctacctgcctaagctgaccattcagccgctggtagaaaacagtatcgtacacggactcgaacccaagcgtcacggcggctgggtgcgcgtcagcatctgggaggaggaggacgccgtgtacatccgcgtgcacgatgacggcgtaggctttgacccgtccgccatcccccagcccggcagcgacgacaagcaccacacacatgttgcgctgcacaacatcgagcgccgttttcagctgctgtacggcgagccctacggcatgtcaatcaaatccgaacccggacacggcacgagcatcgtgctgacgctccccatcatcaccgcaccgcccgaaaaggagaaagacctatgctgaaagttatgattgttgacaatgaatccgccatccgcaagggtctggtacactgcatccactggggcgacctcggctgtgagattgccgcacaggcagacgacggcatgatggcgctcgagcagattccggtcattcagccaaatatcgttatcagcgatatccgcatgcccggtatggacggtcttgagcttgccgagatcatcgcccgcgactatcccggcatcaaagtcatcattttgaccggctatccggattttgcctacgcgcagcgtgccatccagtatcatgtggtggattttgtactcaagccgatgacggtagaaaacctgaccaatgccatcgaaaaagccaaggccgccatagcggaagaccgcagcagtcaggatctgcaggagaagctctccacgacctcggcgcgcaacatggagctgcagcagagcatgctgctgcatgacctcatccaccgtgttgcatgctcgcagctgtatgtgctcaaccgcctggctcagctgaaaatggacctgcgcagctattttgtactcaagctgcatattacctcgctgtccgaggaagcgctgaccgaggaagaatacaacgagtatctcaatcagtcgcaggagattctgtctgactgtctatcctcctaccagcattactacattgcccgcggcacgcaggactgctttgtggtcatctgtgccgccggggaagcgcccattaccgcattgtgcagggaagcggtgaatattgtcggcagtctggcacattttctgctgtttatcggtatttccaactgcaatgacaatcccatctgtcttgccgacgccgccgatgaagccgcacaggcggtgcgcttcaccgtcttcacgcccgaccatccggtgacgcacttcgctgagctcagctcgttcccgcagcagctgaccgacgaaatctttgaaatgctctctgcccttaaatctgcgatggagctgcgtaatcccgccgacacagagcagctgctcgactgcattttcgcctatgcggacagcaacaagctgccgccggataccgtgcgcaatatctgcgtatatattcaccagttcggcatggagctgcagtttcccggaattgccggacattcgctcgagggcggcagcatttcctcgctcaagcgcattatggagaccaactccatcgccgagatggaagcctgcacccgcgcactcgtgcagcaaacgcaggacatggcgcagagcagcgccgccagcgcagaccatatcgtttcctcggtgcaggcctatatcagcgcacactacggtgagcagctttcgctcgaccagcttgcccagcagttctatctcagctcaagctacctctcgcgcctgtttaagcgcgagaccggcacaacgctgacaacttatctgcagaacgtgcgcatcgaagccgcaaaaaatctgctgcgcactacggcgctcaaaagctatgaagttgccgagcgggtcggcattaacgatcccgtgtatttctcacgcatatttaagaagatcaccggtctcaagccgaaggattaccgtcacagcgtgcagaacgaatcatccgtataaacggaaagaagcgaaaaccgctccggcacgcatcccatcagaaccttttccacaattctcaaaatgatctgcgtgccagcaaatcggttgcattttccacacctttactgtataatatataataaaatatatttaattatcagtaaaattcatggcaataccgcatgatcaaacaagcgtgatctgcgagcaaattccacagccggatccgtcgcggtactgcctatataaaggtaatcaggaagatgaatacaacttgggaaacacacaaatttgagcactacatattcagccttttgctggcagcggaagtcattatgtcctttacatttttaggatatgtgcacattccgccgatttccattaccacggcgtatatccctatcatcattaccgcctgcctgtttggcccggccgaggcttccctcgcgggactgctgttcggtcttggcagtttgtataaggcttccgcgacctatgtcatgcctgcagatgcggtcttttctccgtttcggagtgattttcccattggaagcatactgctgagtgtcggcacgcgtgtgctgttcggttttctgctcggctgtctgtttcagctggcacgcaaaagcaaacgaaagaatctgtgcaagctgctcatcacaatcgcggcacctaagctgcacgcgcttttggtttatactgcgatggggttgtttttcccctctctcggttttaatttttcatcaatctttatgcttgaaaaaagcgacctcatcatcctgctgttctgtgctgcggtcgttctggcgattgacaagctgtatcacagttcctttatccagacctataaaaaagcggtcaatgaatacgaaaacaccccgtactggtctccgaagattggtttcgtgctgggggccgtaagtacgtttatcttctgtatggcggtcctctcgaccgtctacttctccagccgtatgtactacatgctcgggcagcacggcatagatgtcacacaggatatccatcgggatattctccacctgcaggtgcagtttttgactgctatgctggcgctcaacttcattctgctcatcctcatcctgatggtctaccgctacatgaaatttcgtgagtacaccggcgagctggacttcctgaccggcattatgggccgcaggctgttcctgcacacctgtctccgcagccagaagtcccacgccggaacagccggctggtttctggtctgtgatctggattatttcaagcacatcaacgacaaatacggccattctgtcggtgatgaggtcctcaagcagttcgccgagcatctgcagaacacctttcgtttctgcggctctgtcggccgtatcggcggtgacgagtttgccgtaatgctcgatataaatctgtcgccggaccagctggagcatctgctgacgcagttcctgcgcgatatttccgatattctcgagcaggtcacggtcagctgcagcatcggcgcgtaccgctttgttttcccgcaggagatcaagcacctgctcactgaaaccgaccgcgtgctctatcaggccaaagagaacggccgagcgtgcttcgtgatagaggattcgactgaaaagtaaattacaaaagcccgcacagcgtaaagcagctgtgcgggtttttgtgtctgttcgatgaaaaatacatgtaaattcatgcagctgcactccgttctgtcaaaaacatgctgcaatgggtcaaatgaaaacgacagcatttgtcgttgtgggatgcttcgcacgagcagattgcccgcatggacggcctgatcaaaaacctggtcgagccggcacgcagtgaggaagatctgcccgcgtccgccgtgaccgaggtgccgctgagtgaaatcatgcagacctgcgtgcaaacctttatcccgcttgcagaatcgaaaaacaaagtatgaaaaacgaggtacatgccctcggttttcatgcatttgcgccgtacatgccgtacatgctatttcatgcgcgctgccgcgcagcagcgtcagcatcgtgaaaacggactttcttaacaagctgaaacggagtgcaaacgcactccgttttactttcgattttagaaaggctgtgtataactccatgtaccgataccgagcggcgagaacgcaaggtaaaccgctgcaacacaaatgagaatcagtgcggtggcaacccagcgatacttccacggggtaagatcgacagcgccgatgtccttctgcacccatgtctccggatgctttgccttgtttcgctgattgaaaataaacatgaccagcagctcaaccggcagcagaacaaagacagcgtacagataatggagcttgctgttgaggaacagcagaaacgagccgtagcagaccacatgcagcaccagaatgacctttgcgctgtatttcggcaggtgcttgaagaaaaagccgccgaatacggccgtcagaaccggcagtgcaatcagcattacgagggaatccaggaaggttttcaagcctgccgggaagaagtagatcagcggaccgacgatggtagtcagtaccgcgaagatgatgccgacattcttgccgaccttgacgagtttttcctcggaagcgtccttgtcgatgaattccttgtaaatatccatggtaaacatggtatctaccgagttcagcaccgagttgaacgaggacaggatcgcaccgagcattacggctgcgaagaagcccatcagcggagccggaacaacctgcgaaaccaactgcgggtacgcttcgtccatcatggatacctgatcgccctgcagctcaaacagcgcatacgcgataacgcccggcagcgcaaggtacataaaaccgataattttaagaaacgcgcagtagagagcacccttctgcgcttccttgaggttctttgcagcaagtacacgctgaataaacgactggtgcgtacaccaggactgcagaccgaggaagaacagaccggtaaatacggtcggccacggaaccgcaggcggcagagaatccgccggagcgatggagttgagcatgtccgaatggttttcgatcaggaaacgcataccgtcgataaccgacagaccgtcaccgcctgccgttttgccgagcacgctcagtgcgaagaacgggatcatgaagccgccgatcagcagtccgatgccgtttacggtatccgatacggctacggctttcagtccgccgaagatcgcgtaaatcgagccgatgacactgatgatgatacacagaatgatgactgcctgaaacttggttacgcccagaatgccggatacgttgaagatattctcaaataccagcgaaccggagtacaggataaccggaatctgtaccacaatgtacagcagaatatacgcgatggagaaccacagcttcgtgctgcggtcatagcgcagaccgatcagctccggaatggtggtaatgccgcttttcagataacgcggcgccgcaaacagcgccagcacgatacagcacggagctgctacgatctcgaacgccatcgggctcatacccacactccatgtctggccgttcgtgccgaccagctgctctgccgacaggttggtcagcagcagcgaacctgcgataacaaagcccggcagtccgcgcccggccagaaaatagccgtctgcggtgctctggtcatcgccctttgtttttacatacgaaataactgcaacaagtatcgtgaaaccgataaacgtcgccatagtccaaaccattggaatcccctctttcacgcggtccctcaaccgcttcaattttccatatgtataatttaattcttaaaaatgcgtatagttagggcggacgcatgtgtcgaactctgcgtccgccctgtctataaaccgtttatgctgtcaaatgtgtgtttgaattactcccacaggcccttggacttcatgtcggagacgtactcgtcgatattggaggagtcgataaccttggagccggagtcgatgaaggattcaacagagccgccctcaagtacggtaactgctgcttcaacagccttgtagcccatgtcgtagcccatctgagcgatgtcgatggtcagagagccatccataacagcctcaatggcagactggttgccgtcaaaaccgcacagaacggtatctgcgtaattggtgttgccggaatccttgataacctttgcagctgcaagcgccatgtcatccgcgatggacagaactgcgtctacgccgttcgggtacttctggataaccgcctccatagcggctgctgccttgtccggcatggtgtcggtgtactgcacttcgagcacctgaccgcctgcggcttcgatcgcatcgcggtagccgcgcagacgtgcttcatgggtctcgtcgccctgtacgcctgcgatgataaccgccgtcggcttgtccttgccgagtgccttgcaggcctcagcaaccgccttgccgccgttcagcgctgcgtcctcgttgccggtgccaacgaagcatgccttcttatccgaggtgaagtcggtatcgagtgctacgaccggcttggtcgcggtatctaccagcgttgcggtagaggtggactgctgcggagcgataacaacggcgtcaatgcccggattgccgagtgcagtctcgatcatgttgacctgctcatcatacgaggtagccgaggtcggagactggatttcgacgtttacattgtcgtgctcgctgccgtaagcgcgcgcaccggcaataaccttgttgaagtgaccgtccgtatgctttacgataacggttacgttgtaggcatcaccggaagcggtggagccgctgtcgcccgtgctgccagtcgatgcggacgaaccgcagcctgccagcatgccggcacacagagcacttgctaacgtcactgctaaaagcttctttttcatggttcaaacactgccctttctcttcttctcatattgattttctttcttctctacagggggtgctggaattgcgaaaatgctgtggacttaaggcaacaccgcacaattaaagcggcggctccttgtgcaggctccggtcgcactgccgcggtgctttgcggaaattttgtgtcctacctttggcttcggttccttgcgcgagttccgtccgcgctgccgaagtttcacggtaatacatcgagtattaccgcaaaactgtgcctcgtcagtacgcaaaatttactcgcaaatcactcttgttcaattatgcggtattgccttaatgaaaaatctttttcttttacggtatcaccggacaattcggcaagagcaattgttcggtgattccgcaccaattactggctgatggtctggcgcagtgcgtcgatagaggtgttgacaccggcatcaacggtcatggtcaggtcctccatctcgagcgaaacatcgccgtcgtaacccatcatgtggcatacagagaagaattccttccaccactgcaggtccttgccgcagccgactgcaacatagttccaaacgcggtcagcggactcggtaacaggacgaggctcgagcagaccgtcggtgtcagccagaccgcgctcgatacgggcatccttgccgtgaacgtggaagatgcagcccttcagagcacgtgcagctgcgatcgggtcagcacccagaaccatcatgtgggacgggtcgaggttgatgccgagcatcgggtcggtagcctcgcgcagcttgagcagggtcgaagcagaccaaaccatcgtgcccgggaactcttcgatcgcgatgtgctcgataccacacttcttgcagtgtgcgatgaactcattccagaactcgatcgttaccttccactggtactcatacgccggagccatgaaatccggccaggaaacggtagaggtgatccagttcggggtggtgtcggtctcgctgcctgccggcaggccagccatagcaacgatcttcttaacgcccagcagacctgccagagtagcgcagtcgtacatggacttcttgtattcctcgccggtcttgctcggccagagcgggttgcaggacgtgttcagagcggagatgcgcatgccgcgcttctcgagctcgcccatgaattccttgcgcttgccttcgtcagcaagcagctccgcggtgttgcagtgcttgcgggcaccccagccgcctgcggtcatctcaaccgcgtcgataccgagggactttaccttatcgagcatatccgtgtaggacagatcagcaaaaacatcagtgcaaattgcgagtttcatataaaaaacctcacttttcttcttttttgttgtagtagaaatcgttggagcgatttttagagagagaattctttcaagtatattatcaggagggaattttagcgttataagcgtttaagagtttaccgctgcccgccttacggaaggcagcggcacagagaaaagaaatgagagagtgtcttagtttagatggaaatcgggagacttacttgaaatctacccatacgccgcccttgtcagcggactctacgcacttggttacccagcggatgccgtcgatgccgtgctccagatccgggtaaaccagattcttgagggtttcctcgtcgccacggttctttgcatccattgcgatagcaaaacgggtgtacaggttgctccaggactcgatcaggccggtgtagtgcagagcacccaggcgctcgtactcgagagcttccggattcaggtaatccattgcacgaaccagcgtctgacgcggctgaccctgtacttcgtagtacagctcatccggatgcatgtcgttccactcgagggaagccttggtgccgacaatgcggatgtgctggctgctcatgtcgcctgcgttaactgcggatgcccacatacggccaactgcgccgttctcgtaacgcatcaggacgtaagcattgtcctccagcggtgcgcgggacttgatgaagctctggcggtcgcacagcagctgcttcagcttcagctgcgggcagatcagctcggacatgtagaaggtgtgggtggacaggtcgccgagtacgaaggacgggccggactttgccggatcaacacgccacttctgaccctcagcctgcttgtcgccggtcgggtcgcaagcgaagccgtgtgcgtagcggaggtctaccatagtaacctcaccgatgtcaccgttcaggaccatggagcgcatctggctcagcaggtcgaaaccggagaagccgtaggttacgcaaacgatcttgcccttttcctcagccagcttcttgatctcctcgccttcctcaaccttgaagaacagcggcttctcgcagattacatgcaggccggcctccagagctgccttgcagacctcaaagtgctggaagttcggggttgcaatatcaacagcctcgatgccgtcctcgcgctttgcttcctcagcgaacatggtcttgtaatccggatagaggcgttcctcatccatgttcaggttcttgccgaagtctacgcagcgggcgaagtccaggtcgaacgctgcagccttaagtacgaacgaggtgttgtctcgcatagcgcccagacgatgcttgtaaccaacgccggaagtacggccgccgcctacgataccccagcggaacggacgagcaattttcttttcaccgataaacataatgttttccttctttctttgatttgcaaaaagtttttgattctgtttttgtactgctaattttgatgttttgtgaaatgcatacaacaaattcgattcatctttgtttattgtatccatttcctaacttctgacctaagtataaaatgttttatggatatattcaataagcgtttctgccgtaaagttcatcaatcctgctttctatgagaaaacgcagaaaaccagttcatcaatcctgctatttcgttcacggattctatgagggcaaaataaggaaggagaagagtatatgcaaagtgttgatcccggcatccgaagtgagtcggtttgttttccgtttacgccgtcgcagaccgcgagagagctgctgttttacccgacatggtgcggtcactactactgcaccgccaactattttatgaagcgcgacagttatccgccgctgctcatcgcctacatccgcaagggacgcttccgcgtggagtaccgcggtgaattccatgtcgccgaagccggtgacgtgctgctgctcgactgcatcgagccgcactactaccacgccgaggacggactggagttcgtgtacatgcactttgaaggctcgaatgcgcgtgagctgtgccgccgcatcaccgaccggcacggctggctcatccgccgcgacaacaacacgctgatcggcaatctgctgtacgacatggtgcgcttttacgatgaaaacggtgtagagaccgacatgcagcgctcggcacgcatctaccgcatgtttgacctgctgctctcgccgagtgccgccgagcagtcagcggatacgccggtcgagcaagccatccagtacattcgctcgcatatcggtcagccgatttccgtggaggagctggcgtctaccgtgtgcctgagcgcatcctatttcgcacatatgttcaagcgccgcaccggcttctcccctgccgattatgtaatcaactcgcgcattgaacgggcaaaagtcctgcttgtgcgcacgcagaagccgattgcggaaatcgccgaggaggtcggctactcgaccagcggcagcctgatcaacctgtttgttaagaaggtcggtacgtcaccgcggcagtaccgtatccggcatatgtccaaagcgattgatgcggtatgcaaaaccgatgtgccgttcatagatacagatgtgccggagctgtaaccgtgcaaatacacaaaaagacgcacatcgcaagatgtgcgtctcagtctgtcaaaatatcatattcctgcaatttaaataattcgcgcgccagtgcgcgttaaaaggttcacggtctgttaagacaacaccgcataacgagaaccacagcttcttgcgcagactccggtcgcgctgctgcggcgctttgctgaaattctgcgccctgactttgctgtactttcacagtaatactcaagtattactgcagaacccagcctcgtcagcacacaaaacctgctcgcaaatcgccttttgtctcattatgcggtgttgcctgaaaggatgaaatgcaatagatttgttctgttttacagttcctcgaccgacacgatgcctttacgcttgccgaccagtgtcatcagacggtttaccgtacagctgcgcggcaggcgcagtgtgaagatggcgcaggcattgtgctcctcgttttccgccgcacgggtgatctggatattcaacaccttgacattgcagctgcggtagagttggagcacatcgtccagacacgttttatcctcgtattccatatacacattgatctcgggaacgtgctccagcacacggtactccagccgtgagaacacctgctctgccagcatgataaagccggtggccagaatgccgccctcataaaagccgccgccgaacgccagaccgatgatggccgaggtccacagtccggccgccgttgtcaaccccttcacattctgccgcttggtaacgatgatcgtaccggcgccgatgaagccgatgccggcaacaacctgcgcgcccagacgcgccatatcagtaaaataatgcatattcagatatagatactgactggtcagcgtggtgatcgctgcaccgatgcagatgaggatatgggtgcggaagcctgccggacgacgcttgtacgagcgctcgatgccgatgatgccgccgcagataaatgcacaggcgagacgcacaaacacagagagtgtggtaacgctgcgcagaccgtcaaaaacagataacatattgtttcctcccgttacagctcttcgatcgcgcacaggcaatccagcccggctagttcggacagcagctgcgtatgcggtattttctcattcagacggatcgaaaagatcgagcttggatgcagctgttcaccgctccggttgcgctcgatgtcgatgtcatagatctgcacattctgcgccttcagctgattgatgatcgtgctgatatcatccatcgagttaaactccagatacagattgatgtcgcgcgcgttttcctgaatgtatgcatccacgattgggaacaggcggatgctcagaaagatcatggcaaacgcgatcagtacgcattcgtaaaatcccgcgccgaccgcaaggccggtgcacgctgaagcccacaatccggcggcggtagtcagtcccttgacctgctgacgaccggtgaccagaatcgtgcctgcgccgagaaagccgatgccgttgatgacctgtgcgccgaagcgggaaacgtcggttttcataccgagctcggctgcaagcgccgaccacgggccggttatcagcgtatactcatacagactgagcagcacggtcagtgccgcgcccagacacaccagcatataagtgcggaaccccgccggacggcgctttcgttcccgctccagaccgatgcagccgccgagcagcatagccagaaccagccgcagcacgaccgatgcaaaatgaaattcacgaagatatgcaatcgtttctgtcatgttctgctcctcctcatttcctgcggaaaccgtgtacgcacacgtttgcgctgatggtcggtttacacaccgtactccttggtatatatacagtataacaccggatcaggtcaagtttcatccctcacattgtaagaagtattttgtttatttttgtgtaatttgtacattcgcaaacgtttgtgtatttaattatctccatattattatatattaagttctaaatatctgcatttgtgaaaatttttatttcgatgcggcctctccgaactgttttttcccttccgcagagcgcaaatccccccattctgcacagattgtgcaggacaggggtattcgttccgtttcgcacgaactgggcctgcacgcagcgcaaggcacttccgccttacatggtcccttcctcctccattgcgctgagcagcggcgttaccatctgctttttgcggctgactacacccggcagcacgaccgaatgctccccgcattccttgcggaacgcggtatgcaccagattctttgcgcccctgccgacatagagcagttcggtcttttcctcgatgatatcggtcagcatgacaaactgcatggacagaccgctcgtcttgagatagtcctccatatagtccagcattttatcccgtatgccgttcagctcattctcgctgacactcgtgatctgcgaaatggcgatttttttattctgtacctgaaagtacttgaaatccatgtggaacagctcatccatcgaacgatcgcgcaggcacgagctggagcggaacatctccgttgcatactctttgatgtccagacctgcgatctgcgccagttcttctgcggcggcgcggtcgagcggcgtacaggtcggagaacggaacatcagtgtatccgacagaatcgcagagcacagcagacctgcgattttcggttcgatcggcacattatgctcatgatacattcctgtgataatggtcgcggtacagccgagcggctgattgcggaaatagatcggcccgctcgtttcaaccgaatcaatgcggtgatggtcgatgatttcaatgatattagtcgaacgaatgccgtctgccgcctgatcccgctcgttatgatcgaccaggatgaccgacggacgctccagatccagcagattgcgctgagaaaacattccgatataccgtccctgctcatccagcagcggatagtagcgcatacgctttttggataccgcacgctttacatcctctaccacgtcatcgggttcaaaggtgatcagtcccctgcggcgcatgacatggcgcaccggcacagcctgactgaccaccttggcgcagctgtatgtcgtcagcggcgttgcgatgatggaaacctgattttcacttgccagcttgcggatggtacgcgagactttcgcgccgagcccgataataatgcagcccgcattcatctcaatggcgcagagctgactctcatagcggttgccgagaataaccatgtcgtgcggcccgatataatcctccagaacatccggattggctgccgcaaccaccacgctgccctgctcgaaccgcttttcgatatcaccgacaatcagcgtaccatccaatacatccaccagattgcgatagcttgtgccggcctccgccaatgcgttcgcgtccttgtcctccatatagaagcgcgcgatatcactcagcgtcagcagtcccttgagatgacggtcctcatcgacaacagccagcgtctgaatatcattttcgttcatgtaattccatgcgcggtgcagcgacatctcctcatcaataccgggaatcctgcgatactgcacatcgctcagacacggctcaaacgacttgatataccgcggtgctttgacatcgaagcgctcaaggacaaatttggtctctgtattgacatggcctgcccggcaggggatatatggttctccggtcagcctgtgcttaagctctgcataacagatcgcagagcagatcgaatctgtatccggattacggtgtccgataacaaaaaccgggttcatactgtaccgactcctttgtctgagaaatgaccgcgggaactgctgtggttttcccgacggtgtatgattgcgggtaaaaggaaacagcagcaccgaccatgccactgattcgggtgctgctgttcccctcgggaagaaataggacaataccgcataattaggtatcgtttagatatggtcaatatgattttccatgcggatcatgccggaaacacctgccagctcctgacagaatgcattctgcgcggactcatatccgtgcggcggaaagcttgcacggaaactgatgatataggtgttatgcggagttctgccgaaggacagattaagcagctttgcgaaatgccgttctgccagatgcgacagctccaccatgatgtcgcccatgtggtcacattcgatctgcagatccagctccgggcgccttctggtgcggattttctcctgaatcccgtcaaacgccaccagcgttacaaaggcaatcaccgtaccgaccgccgtgagcacatagtatcccatgccgaccgacagaccgagacaggcaacgatccagacactggccgccgttgtcagtccgcgaacggtaaatccctcacgcaggattgcaccggcacccagaaaaccgatgccgttgatgacctgtgcgcccagtcgcgccgggtcagagggcgttgtgccgaataccgcaatcgtctgctcatacatgatgcagcttgtcaccatgaccacgcacgagccgagtgcgaccagaatatgtgtgcggattcccgccggatgcgaggttcgtgcgcgctgcgcgccaacggcaaacccgacgatcactgcacccagcagccgcagcacgatatccaccactgtaattttccccattttcgtttccctcctgtctaaaatatttgaccgcaccctgcaatggcagggtacggtcagaaaaagagagagagattgttacggttacgttctttttcttattgcatcgtcaagcgctctgctcgatttcgctcctccagataatctaccaactccggcaattcccgaatgatatgatccggctggtaagcagcatctacaccggcatccttctgcgccgacaggaacgactgaatctggatcgcggcaccgaaatgcattcgctttgcaccgatgatatcacgcgagatcgtatcgcccacataggcacattcctccggcttcgcctgcatctggcgcagcgagatctggaaaatagacggatgcggttttcggtatccggtcacgctggacagggtaacatcttcaaaataatcgcggattccgtactgctccagcacatcgaacaccgaataaagcgatgccgtattggagatgacgcccagatgatacccgcgttttttcagctcctccagtgtttccttgaccttcggacgaagctcgcggtgataataggtcacttcccacatgccggccagctgttccgctacctcctgcagcctttcacggttcagattgaagtccgccatataatactccggccagatttcctccggttttttctcaagttcgttggattcgctccattgtttgtaggtacggataccgctgttcagcttgttccagaaggtaatgtcattgcagcctgtacccagatcatgttcatcgaggaacgtccgcagctctccggtaaccgtgcggatcgtctgatcattataccagatatcctcgagcgttcctcccatatcaaataaaatagtcttaatcacgtttactcctccttctgcggcagtgcaagggaggcacgaaccacattatgatcgctcagctccggctgtgcataccgggccagcgcactgtccggcgcagcaaagccgcagtctgccgtcagtgtagaaatcacactgctgcagtgcacggtaaagccgcgcggcagcagccaatccagcttcatatgcaggcagccgccttccggcagcggtttgcgccgtgtgcagtccgcaccgcccgaagcctcccgccatgcatagcctgctgcagtgcagtcctgcagaagcggttcataccggtcgatcatttcgatcgccgcagccagctcctccggctcgtcacacagatgacgaatcaccgccttgtcgcgtccgtcaaaggtattggtgttgagatcgccgcccagcacaacgggaatccccggaaatacacgctcgacctcctgcagcacagccttcatctgctgcaggcgtcccgcgccgctcgtccggttttccagatggatggataccgcgccgacctcctgcccctgcacatccagctttgcaaaaaccgcattgcggccgccgatgcgcttctgtcgatcgtaataccagttatactgctccggcaggcggagcacctctgcccacagaatcggccagcgcgaaaagatcgcattgccgtgaaacccgtgtgcagcgtccttcagctcgacaaactccagcccgaacacatactgcattcccagcgcacgggcgatctctgcggcagtatcccgctcacccgaccgggcacagccgctatccagttcattggccaggatcaggtcatacggccgcagcgccgggcattccttgagaaaatccaccgtttcggcaaggcatatgccccgctccatgttgaataccagcggattcagttctttcttctgcggcgccgcacccgcaaaccgggtcacgatctccgcctcaaaaaactgaggaatatcctgcatcaccgcatcctgcgattcctgctccaaccgtgccgcagattgcagcacgcattcttttgtcagtttttccatactgctcctctttacaggcggcgcggcatcgggtttttgcacagcttgaaatataccgtccacgatactgcgttgccgacaaggattggcatcagggtatacaggaaggtcacatacagcatcatattccgggcagcaggctccagctggaacgctgcgaccacgcacatgatcgtgataaccggcaggctcgcaaagctgtaaggcacaatccgcttatccggcagcagaaacaggatgcagcagaccgcagtgcccaccacagcgatcagaccgcagtggatccagttctctgccatgcctccgccgagaggcagatggtcatgcagtacgccggtcagcagtgcatacataccgccgaataccaggcagaacagcaggtccacgaaaaagcaggtaactgccatcggactcttgcgcttgccttccttggttacgaataaagccattctgtatgctccttccgcttttactgtccgcggcaggcttttcagcctgccgcgtccgtatcgttttctcttttgattacgtcttagccaagcagcgtccagaaatcacgaaccgggttgatgttctcatagatatcggtaacgttgaaatcagaaacatgcagctcgctgtacggggtggaaccctcagccggttcgatatcatcgcgtaccggccagccgcccagcgtattgaagtacttgtagccggatacatcaccgtctgcgccgcccatcatgaagcggaccagcagcttggcagcattcggatgctcgcactcgccgacaacgtacagggtgttaatctgcgggataccagtggtcggctcgaggtttaccggagcgaggcaccagttgttatcctcgttcttacgcagcttggaggaagcgcagaagccgatcggcggattggtctgacccttggtacctacagcttccgcgatctcgtcagaagaagaggtgaagatgggttcgttgtcatgcagacgcttgaggaactcatagcctgcgttctcgcagccgtcggacagcgtcagctctttaccgtacaactccttgtaggaagcagccagctcatccggaacatcgcctacgcagaaaccggtgatccaggagccccatgccagattatccagcgggttctgcatcatgacacggcccttccagtccggctcggtcagctgccagatattcgtcaccggagaaccgtccggataagcttcactgttgtagaacagctgcgtcagctcgacatacatcggggtctgcgtcttggtgtacttttcatcaatgtgcgacaggatatctgccggcttgtagttatagaacttgcgcggcagaatatactcgttgtacagcgtaccgtcctgatccttgatatgcaccacgtcggcaacgtgctgaccggcatcatactcacgggtaaccttttccagcagctcgttggtggaaatatcgaacggctctacttcaacgccgggatacttctccataaaggcattggcgaccttggtgatacgggaggaaatcgaatagatggttaccttgccctcttccttcgccttctcgtacagttcctcatcggtctcatccgtgttgaagataccggaggactcttcccactcgctcagctggagcgtgcccgctgccgctgcctcattcggatcctgtgcagcatcgctgctctggtccttcgtcgctccgcctccgccgcacgcggtcagcgagaacatcattgttgctgccagaatacctgctaaagtgcgcttgtgctgtaacatttgtttttcctccttcagtttcctctcttcttttcttgtgaaagtgtgaattgctggtatggtgcttattcaaccgaatacttgatgaggttttcggttttcttatcaaatacgttgatcttggtggtgtcgatcgacagatagaccacctgatccgggttgtaatgcgtaatgccgagcgccttgatgaccatgctcacgccgccgaccttgacggtgaccagagtctcggagccggcaggcatcgaggtgtagatatgcgcttcgatgtcggacggggactgacgcgaggtgttgatggcaatctgctccggacgaatgccgagcactgcatcgaacgatgcttcctgcggcatattctcgtccttgagatgatcggccgggaatgtcatccgacccagcacgctgtttactgtcagaccggaagcggaaacctctgccttgccgtcaacaaagttgatgcgcgggttgccgataaagtctgccacatacagattggcggggttgttgtacagctccagcggatgtgccacctgaatgatgatgccttcgcggaaaatcgcaatcttggtggacatggtcagcgcctcgacctgatcgtgggtaacgtagatcatcgtcgtgccggtttcggtgtgcagacgcttgagctcgctacgcatatccacgcggagctttgcatccaggttggacagcggctcgtccatcagcagcagatgcggctcggaagcgatagcgcgggcgattgcaacacgctgctgctggccgccggacagctcggacgggtaacggtctacatactggccgatctgcattcgtccaagggcatccttgatgcggcgatctacctcatccttgggcagcttctggatattcagaccgaacgcgatgttctcgcgcaccgtcatatgcggccacaatgcgtaggactggaataccaggttgaggtcacgttcgctcggaggcgcgaaatgagcctccgcagcgttgacgatttccttgccgtccatgtgaatggtgccgttctgcggcttctccaagccggatactacacgcagcgtggtagttttgccgcagccggacgggccgagcagcgtcataaagtcaccgtcttcaatcgtgaggtttacatccttcagaatgtggttcttaccgtagaatttatcaatatgcttcagttcaattttgctcattttccaaactccttttttccggttataccatgcggatcaaccgcccatgctcttcgccagatctgcgtcgccaaagatattcgccagtgcgtataccaggaatacgatggagaacatgacgattgccacgcagtcagaagcctgcggagagttactgttctgatactggaatgccaaatacggcagcgtggaggttttcggggtcatcagcaggatgatcagatcgagttccttcataatggaaacgaagatcagcatgaagcccgaaatgaagccgcccttggaaagcgggaatacaatgcggataaagcgcttgaagaagcctgcgcctgcaatctcggctgcttcctccagctcgccgccaatctgcagcatattggaggtgccggcgcgggaagcgaacggcagatgctttacaacagaggtgatggtcagcagggcgaacgtgccgtacagggacggaacgagcgttacgccgaacagctgctgcggagcggagaacatcgacaggaaaatgccgccgaatgcgatggacgggatcagatacgggatgaataccagctgctcaacaaccttgccgtgcagcttgccgcggcccttggcgcagatataaccgatgatctgaccgaagatggtgccgaatacaccgtttacaaacgtcagcttgagggaattgatcagcgaattgataaagttagcattcttgaagatacccggctgaccttccattaccgttgcgatcggatcgccgatccagtagtgcagcgtcaggttagacagcgagtagtcgccctgccggagcataaaggactcgaggatcagcagtgcgatcggcatgatgatgccgaaaacgaagaacaggaacagcacggccgtgatcagcagcttatgcttgcccagacggatcggggtggaacggccgcccttgccgccgatggtggcgtaggacttgcgcgagccgatcagcttctggttgacaaataccgagatcgaagcgatgcagatcatgatgagtgccatggcaaacgcggtctgggtattctgggacttgctgttcatgtacagctggctggacagggtcacgaaattgaccttggagcccaagtagttgataacgccgaaggtgccgatcgccttggagaaggtcaggataacggcggaaagcatagccggcagtaccagcgggaaggtgatcttacggagaatggtcgccttgccggcgccctggatctcgcccatctcctccagctcggagttgatggagttcagtgctgcggaaaccagcagatacgcatatgcgtaataatgaagcgaaagcacggtgatgatcgcgaccgggccgtatgccagccagtcgggaacattgatgccaagactcatcaggaagcctggcgcaccgccgatgcgttcggtcttgaacatggtcagccaagcctgcgacttacaccagctcggaatcatataaggaatgataactgccagcgagaagaacggcttgaagggaagatccgtgcggaccatcagccatgcaagaaccgatccgatcaggatggcgaagaacgatacgcagacaccgatcagcagcgaattgagcagcggctggagcagcatctgcttggtcagtgcactgccgagcaggcgctgccagtaatacagtgtgaacgatcccgctgtgccgcccgccagtcgtgcatccttctgtgccagcgtaaacgaggtcgaaatcatatccagcagaggaaaaacgatcaagtaggtcagcagcacgatcgcaatcagcacgatcaggttatacgggttggtgacaaccgccttgatctggttctttaaccttctggatttggagtagttctgatcttttggtttcatttcagttttgcccctccttcaaattccgattgtattgttccaccgcggtcaccacttcgggcagcgagccgatcttgacatccggctcataccccatgccgcggtacttttcgtccttgtgataaatgcgagggttatcgatctgaatcatcagcggccatccggcgttccgcacgccgcgcacatcgcgggagatggtatctccgacgtaagccgcctgttctttcccgattctcatttcgttcagcgcgatctcgaaaatctccggccgcggtttgcggatgccgcagacgctgctcatggtgagcgtttcgaaatactgatcgacgccgtgttcctttagaatacgcggtacgaaggtcgtgctcataatgttggagattacacccagccgatatccgcgctgcctgagagcctccagcgtttccttcagcccctcgcgtttgacgatgtgcttgcggtatcggtcgaacatgtagcagagctcctcgcccagtcccgcaagtttttctgccggaatgtcaaagtccttcaggaagaacttctgccagatcacatccggcggcagctcgatcagttcctgttcggtataggacttgtatgctttggcgcctgcattgatgtgctccagaagctgctccggcgtttctgctgtgtaaatatgattcatatgaaggaagcaccacagtcggcggatataatcgcggtcactctccggggtagcgtcctgtgtatgtacggttcctccaatatcgaagaaaacagcttgtatcataacaactcctctctcttcccttttttctttactcctgcattttcatttgcatcacgttttacgcaaacgttttcatttcctgattcaaccgtaccactatctcccggctatgtcaataaaaaatcacattctcctatcaaagttttatgatattcacaatttacatccaggtgttttcgttaattatgcacagttgcttttctctccacattcccgtatactgtaatcaacgcaaacgtttccgtagaaatgagaaagaaggattcgtatgaaatatgatcttatgctgatcggacccgccacgcgggacatcaatatcgactataccggtcaggaagtccgcgaaatcggcggcgctgtattcttctgtgcatacgctgccgcagccgcttccgcaaaccttttcgcttcagtcaagatccatccggacgataccgatgtactggatgcatttcatctggacagcgaccatatcgccgtgctgcccgcccaatgcaccaccctgatgcagaacacctacttcaccgccgaccgtgaacgccgcaaggccgaatgcctggcacagtcggatgccatcactcccgatcagatccccgatgtggactgcggcctgtatcatctggccggtctgctgtacggcgatttccccaacgagctgatccccgcgctttccaaaaaaggcaaggtatccgcagatattcagggatttctccggcacaacgaaaacggcctgatgaacttccacgactggaaagacaagctgacctatctcccctattttgactttctcaaaaccgatgcggcagaagccgagatcctcaccggtctgaccgaccgccgcgctgctgccaagcagctttatgaatggggcgcaaaggagatcctgatctcgcacaacagcgaaatgctggtctatgacggcaaggactattatacctgcccggtcaaggcacgcaatctgtccggccgtaccggacgcggtgataccaccttcggtgcttatcttgccaagcgcatgatgggcgtttccatcccggatgcgctgctgttcgctaccgcagccgtttcgctcaaaatggaaacccccggtccgctgcagggtcccgaacaggctgtcctcgactatatcaaggaattttacgcctgagtccatccggaaccgcttcggcacccggaacatatctgatatttttcccgccttctgccgttatccttgtctttccccggcaaatccggtattatattcttattaaaactactatgggaaggaagcggcatctatgcgacagcacattaccatcaaagatatcgcccgcattgccggtgtttcgacttctaccgtctcccgcgcactcagcaattcgcctgaactgagcgagcaaacccgccagcggatcctggaaatctgccgacaggagggctaccgtgtcaatgcactcgcacgcagtctgatctgcaacaaaaccaacgtcatcggcctgatcgttcccgaggtgaccaatccgttctatgccgaactctctctcggcatcgaaacgcacgcacgcagcctcggctacaacatgatcctgtgcaatgggcagaatgatcccaaagtgaccgaagagctgttcggtttcctgatcagtcatcaggttgacggcatcatccttgccagctcacagcaggatgcaggaaccatgatccagaatttcgctccacgactgcctaccgttctgctcggaacgccggcactcgtcagcggcgatgaggtcaactcggtctgcattgataatctggcaggcggccgtctggcagcagagcatctgctggagctcggccaccgtgacattgtctatctgggccaccgccccaacagcctgacgcaccagcttcgtctgcgcggctttaccgaaatactggaaaaagcaggtatcaccccgcaggtcatcgacaatccgcatggttgctcctcgatcgacatcggctatgcactcagccggaagctgttcgcaaacggctgttccgccactgcgatcttcgcctcgaccgattccatggcgctcggcgtattgcaggcagcagacgaatacggcatctctatccccgaggatatttccctgctcggctttgacaacatcatttattccgcactgccaaagattgagctttccaccatcgatcagcgcaagcagcttcttgcagaagccaccgttgatctgctcacgcgcatcattgattcggatgcgcaggacgagttcacgcaccgcatgatccgtccgacactggtttcgcgcagctcatgccgcgcacaaaaaaagtaaatccacagcactgcgcaccgaccgcctttctctcttagcccttttatcacacacaatacaccaacaggtcaaccgcagcgctgctgatcgagaatgccgcagaatcctgcggcattctcatacacaaaaaggaggagcttatgtaccgcatcgaaacccatctgcacaccacctatatctcccactgcggctggctgggcgctcaggccattatgaaatactactccgcgtgcggctatgatgccatctgcgttaccgaccactacaaccgcgagtgcttcgactacgccgacatcgacctgaccacgccgggcagcaagacgcaggcgttcctgctgggctaccaccgcctcaagcgcgaagcggagaagtacaatatccgcgtgtacgcgggcgctgagctgcgctttgacggctcggataacgattatctgctgtacggcttccacgacgagctgctggccgatccggatcgcgtcatgcgcgagggtctggcggcctttgctccgcaataccgcgcagacggcgcactgctcgtgcaggcacacccgttccgcaaaaaatgcacccccgctccggcggaatatctggacggcatcgaggttctcaacctcaacccccgccatgacagccataacgatcttgcgctggcttatgccagggagcatcatctcatcatgacggccggctcggactgccaccgtcccggcgatcagggtacgaccggtattctgtccgacaccctccccgaagacagcttcggtcttgcagatctgctgcgttcgggcaactataccatcatccatcccgaatgcaccgaggattgagacaaaacgataccatgtaaaagctgctgttgctccaacgcaacagcagcttttttctcatacaccgcgtcttattctcagtgtaccgcaaacgttttccggttgtattttaccttttattcttcttgtttcgtgcagtttgcctttccaattgttcattctgcataaaagtatttttattttgttgtatattccgtatacgtttgcgcttgttttgcacaaaataatctgctagaatatcatcagttaaaaaaacaagactgaattgaggtaattgtaatgcgtaagaatttttccaagtttctgatgaacaccgctatgtttgagctgtcctgcgatccctgcaccgctaagctgttcactgcacgccgcaccaaccgcaagtaagctgctcctcagaaaacacaaactccgcaagcgaaaacgcttgcggagtttttttctgttccgggcagcggcagccgccggctgcgcccccgtttatggtttatctttcaaagaatcatgctgcaatacgctgcatgatggtcgccatctccgcgcgggtgatggtggacttcggtgcaaataccttgcccggcttgccctgcaccagaccggtctttgcacagtaggctacgcctgctgctgcccagtcggcaatcgtgccgccgtcggtaaactgcttgacgatactgccgtctgccgcggtatcctcaccgctcagcttgcgctgacgggtcagcagcgttgccgcctcctgacgggtgacgctgcggtcgggcgagaacttgccgccgccgacaccctccatgataccggtcttttccgcccacgcaatagccgtgcgagcctgatgcgttaccggaacatcgctgaagctgtcagtcagcttggtcttgggctgacctgccagattgtacagcgcctgtgcgacctgcgcacgggtcagcgccttgttcgcgccgaacgtatacgccttatcgccggagagcagaccgttcttggtgacgtaatccgccgccttgtagtaccatgcgttcgccggaacgtcggtataatcggtaacagatttgccttcgcgcagggtattgcggatctcgtagctgtccactgccttgaagctgttccagttgtccacatcctgcttctggtaagcggtgcccttgatggaatcctcgttgaactcgatgatggagaatacctgcttatcctcttcatcggtgtagaaatcggtggagtagtccgaacgagccggaatgtactcgtagaacttattgcctaccgtaccgccggtcagataggtcgtgccgtcgccggtgttgaccttgatgtcgttcttcacggtagaacggatgtagatgtggtcgtggccgttgaggaacaggtcaacgcccatggcgtcgagcgaatactcgctgtcgttgatgtaatagtcgcgtacatccagcggatcgtggttggaggtatacgggcctgcgtgcgtcataacgatgcgccatttcttgtcggaagcatccagcacgctcttgcaccactggagctctttcttcatgatctcggccttctgatccgccggagtgacttcgccgttcaggataacgaagatagcatcgccatattcgaagtagcccatcgtgcggtcaaactgcggatagccggtctttgcgcccgacatattgaagcgctgtgcgaacgatacgaaattccagtcgcccttcatctcgtggttgcctgcaacggtaacggttggatacttggcatagtaatcgcccataacctcaaagcaggcctcccattcggtggacttatagccgttctgggtggtgtcgcccgcggagatcatcagatccgggttcgggcagatcttgagtgcctggtcgatggagtccttgaagctcatgtagttttcaacagattcagactgcgggtccgagtagaaaatcaccttaaagctcttatccgctgcagacttcggagcggtgaacgacttttcctcgctcataaacgaaccgccgtcgcctacgcggtaaacatactcggcagacggtgtcagaccggtgatctccacacgatgtgccgccttttccttatagcctgcggttacggattctacataagaggtgccggacttggtttcccacttggaagcaccctttaccttgtactggataacggtcttggtgacagcggggtcagtcagccagctgaagcgcaggccgccctgcttggtatccggcgtaatggtaatctggtcgggttcgccctttaccttgccgtcatcaatattcagcacgatcggctcggacttggtgtacggcttggttacggtttccttgtcggtcttgacctcgatgtagtagaacatatcgccggtcttgtcggtcggcagagaagctgtgtaggtgccattcgattccttcatggcaacagcggtatcgaccttggaagaatcatagccgtaatacagtgtcgcgctctgcaccttgtcactggtgacgatgcgggcagtgacttcggccttgccgttgtgcggcgcggtgttcagtgcgcgggagatgatgcgcgtgccgctgacggtgtaatccactgcggggaagatggaggcatcatagccgcgcagaacaggctgcttgccggaggtgctccagtcccagaccttgctcatatcccagccgagtgcttcgtaggtggccttgtcctgcatttttgcagcggaaacgtcctcccacttgatgggctgctcggtcggctcgttgccggacagcagcgtgccctcccatgcaatattgtcggtgatgttggtagctgcctcatcatcgagctggccgacgatcttgtcaacatctgcaacgccgttgataacggtctgtgcggaaacgctgtccttgagcgtttcaccagcattgaacgaaccggcgataccgcccgcatgacctaccgtgccgctctttgcggtggtatcgaccgtaccggctgcaaagcaacgtgccagatagccgccgccgtcctgaatgccggcaacgccgcccgcatcatatggagcggaaacgtctgcgttgacgtagcagtcctcaacatgaccgacgatcgggccttcgccctctttcagcttgccgcagatgccgcctgcggtgtgcgagttggacagatccaggcacttaacctcaccggtgacaacgcagccggtaatcgtaccgtagtttacgcctgccagcgcgccgacgttctgctgaccggtaacgtagcagtcgagcagcgcaacatccttaatgtacgcctgatcgtcctgattgccgacatagccgaacagaccggcatatttcttttcatattctacgcgcagtcccttgatcgcatggaactgaccatcaaatgtaccgataaagccctgttcctttttggaagcaataggcttgaatcctttgacgccggtcatatcaatatcggcagtcagaacatagtgtccatcgcgtggagtgccgtccttccagctgccggacagatagagcagctggtccggggtggagatttcatagcagcccgtcgccttgttgtataccggcggctttcccttgtcgccggcagcaaaggctcccgtcggaagcatcgtcaaagccattgcagcagacagcgccaaactaagtatgcgttttttcatgtatctcggaccctctttcttaaaattctttttctttctcgattctgcagcgaaatctcattcctcctccccgtgcaacagatcgtgtggttatgcattccgttttctttttcgcaaacgtttgcgtaacttgtacttataattctatccctgttccgtcagaaaagcaatctcacttctcaccaatcttttcaagcaaaaattatgcatttcttcctcagcgccgtgtccgctgctgcgcgcagcaaagctcccgccggaaccgatcaaccgttccgacgggagctttgctgtaattaattatccctgcctgcgggcaatggcgcgcagagccgccgccgtgatgtcctctgcagtgaggttatactgctgcataaggaaatcctgcggaccgacctgaccgaagcggttctggatgccgatgcgctccaccggaaccggattctttgcgctcgtcaggttggtaatagcagagccgagaccggtgccgacctgatggttctccgctgtgacgatgcagccggtctctgcagccgcacggagcaccagctcctcgtcaagcggcttccaggtgtgcatgtcgatcacgcgagcggaaataccctttgctgccagcatttcttcggccttgagtgcctcgtctaccagaataccggaggcaataatggtcacgtccttgccgtcacgcagcgtaacgcccttgccgatctcaaaatcagagtcatccgcgtaaaccgtggtaaagcccttgcggatcaggcgcatgtaggacggactgccgcaggcagccagctttctggtcagtgccttggtctgtgcaaaatcgcacgagtcgataacgactgcgttcgggatgttcatgtacagcgcacagtcctcaaacggcatatgagttgcgccgttgaacgctgcgcagacacccgggtcggaaccgatgacatgcaccggcagctcagagtagcctgctgccagaaatgcctgatcgaacatacggcgggcagcaaagcagccgaacgagtgcgcgaacacggtcaggccggtggctgccatgccggaggcaacgcccatggcgttctgctccgcgatgcctgcgttaaaggtctgggccgggaacgccttcagcagctttccggtgttgatgcagcccatcaggtcgcagtcgatatgcaccagctttgggttctccgccatcatttcgagcatggcttctacatagccgtcgcggttggcgcggctgtccttttcatgcttgccgatcaaagtaaaactcattgtgttcccctcccttacttttcgtttttcactgcagccagagcggcttcggatgcggcaatcgcttcatcccactgctccttagtcggctgcgaagaatgtgcgccggacggctcggcaaaggttgctcccttgccctttaccgtgttcagaatcaggcaggtcggcttgcccttgcacgccttcgcctgctcgagcgcgcccaagatctgctccacgtcgttgccgtcggctacgtcgataacgttccagccgaatgcgtcaaacttggcgccgatacccttgccgtggctcataacatcggcaaccgcgccgtccagctggcggccgttgttgtccacgagacatacgaggttatccagcttgtagtgcgcggcaaactgtgcgccttcccagatctggccctcgtcacactcgccgtcgcctacggcaacataaacacggctcggacggttctgcacgcggctgccgagtgcggcgccgatggcttcgctcatgccctgaccgagcgagccggtcgtcaggtcaacgccgatggtcttgctgcggtcggtatgcgacgggaaattcgtgttcggctggttgagcgtgtacgcgctctccatcgggtaatatcccttgaggccgagcgtcgcatacataaccgggccgccgtgtcccttggacagaacgaaccagtcgcggtcctcccaatggggattcttcgggtcgatgtgcatgacctcgccgtacagaacggccattgcatccgccatcgacatagagccgccaacgtgaccaaaaccgcgggacgcgatcaccttgagcgtttccagacggatttccgccgcaaacacacgcagctcgtgcagtttttgcttatccattgctttcctccttgaaattacggtttgcagaacaaaacccgcccttccgcaataaaaaggacgggtcttgtcagtttttatcggtgaggctgcgtttcgggtccgccctgccggttagacatactccatttttgacatggaaccgccagagcttctcctgtgccgcagctttcacagaaattacttgattcttgcgatcttcttcgccagttccttcttcatttccatgttggactgacgggcgatcataatgcgctgtgcctgcggagagcctgcgccgtgcatggactccggcagatagccgacggcagccgtgcccatcgtcatattctcgagcaggcgcagcaggcgcatacgatcctcggtcggaacggaagccacacccttgaggtacttctcgatgtaatcgtgggtagccgggttgcggtaatccgcctcggacggctgcgttaccatgatgccgccggccagatcctgtgccagacgagcgatctcatacgggaagcgggtgacgttctgcttgcagacgttcgccagcagcaggtcaatgaggtagttgccgctcttggtcttggtgccctgagacgagcatgcaatgccacagcagtacagggtttcgttcaggtgggtcatctcgatcagcttatccttaacatgagaagcctttgcagagccagccatctcacctgccagtgcggtagcgccgatgagcacatcgcctacaccaaccttgcagccgccgtaggactgacggtgatagcctgcaaagcgctctaccatcatgccggcaaactgaacttcgccgttgaggaagatcatatcgttcggaatgaatacacggtcgaaaataaccagaacctcgtgaccgccgtaaaccttgttgccgacgtcgatgtcgttatgttcctcggtcttgcgggtgtcacaggactgacggcccagaatcagggtgatgccttccgcgtcggtcgggcctgcgaaggaaatggcgtagtcctcgtcaccctcgcgcatggagatagtcggcataaccagaacataatggctgttcaggtagccggtctggtgtgccttcgcgccggtaacgtaaacgccgtccgcggtgcgctcgacaacgtgcaggaacagatccggatccgcctgcttggacggagaaaggccgcggtcgcccttaacgtcggtcatagcgccgtcaacgccccagtcgttgttctgcacatcggtccagaacttgacgaaattctcgtggtacttggtgccgcaagcctcgtcggtctcaaaggtggtggagtaaaccgcgttagcggcatccatgccgacacagcgctggaagcacgctgcggtcttctggccgagcagacgctgcatttttacctttttgatcaggtcgtcggtggactgatgcaggtgggtgaaacggtttaccttcttgccggtcaggttggacgttgccgtcatcagatcttcgtactgcgggtcctctgccaactcgtacgttgccgcaaacgagttgagcgacggacgaacgatcgggttgtccactacgttttcaaccttcttgccgaagctgtacaggttcaggtgcagcccccgcagagagtcgatgtactggtcttttgtcatcataatatcatcttccttgtcctttttctttcttttcaataggaaaaagcgccgattaaccaatttttataacatatttgaggagacatgaagggaatagtctgatttgtaatgagaatagcagaaaaatcggcttttcggcgcatatccacgaaattatacgctcagcatcaggcttgtgatataaacgcaccagccggagagcgtgatcagcagcagcaaaatcacatgaatataggcgatttgaaaacgggagaatgtctttttcatcgttatgaccccctgctgtatgttgaattttaattggttacaccttgagtttttcaccgaagcgcttctcgaattcctcggcaagttcttcacggaatttgggatgcgcaatggcaatcagacgctttgcgcgctcgcggagcgtttgaccgcgaagctgcgccacgccgtactcggtgacaatataattgacatcgcagcggctggtggtgacaggaccgccggtggtaatggttgtaacaatcttagatgcagactcgtccttggtggtcgagtgcagcgcaataatggaacggccgcccttggacaggtttgcgccgcgcacaaagtccatctgaccgccgatgccggaaatctggcgcaggccgattgcctcggcacagacctgcccctgcagatcgacctcgacgcaggagttaatggaaaccacgttgtcgttctccgcgataaccgccggattgttgcagacatccactggaagcatgttaataatcgggttattatccacgaaatcgtacaacttgcgcgtgcccatcaggaaggtgacgctcaccttgccgatgtcgcgctgcttgcgcttgccgttaatgttgccgttttcaagcagcggcagcacgccgtccgagatcatctcggtgtgcaggccgaggtcgtgcttgtcaccgaggaacgagcagaccgcatccggcaccgcaccgatgccgagctggaggcagtcgccgtcccgcacgagttcagcgatatatttgccgattgcacggtcttcctcaccgatcctgggtggcttggactcgggcagcggctcccacgagcacaggaagccgtcgatctcggacacgtgcacaaagctctcgccataggtgcgcggcatattcgggtttacctcagcgataacggttttcgcagatttgaccgcctgtgcgccgtaatcgcacgacaggccgagcgaaacgtagccgcgctcgtccggaggcgagcaggtgaacgcgaaaacgtccaccggcagggtgttgtcgcggaacatacgcggtacgtccgagaagaacaccggggtgtagtccgcgcggtgctcggcaatgggcttgcgcgccgggccgccgacgaacagcgcgttatgacggaaatggctctccatgccgggctgaagatactcgcccgagccgagatataccatgtgagcgacctccacattgtggaactgctctgccatgcgcgccatcgtacgctgaaagatgatcggctcgcctaccgcatggccgaataccacgcggtcgccgtcatggatcacactgaccgcctgttccggggtcatcgtgtgctccttataatacgttctccaatccatgcttgtccctccgcagttaaaatgccttgcggtaaatgtcgagcagatcgtcctcggtcagttccacatagttgttgccgagcaggcgctgctgggtttcaatgacattctttgcaaagaccggcagctcgtcagcggttactccgtgttcgtgcaggggatccttttccagcacctcgtccatcagcttgtacagcgtttcgagtgcgaataccggctcggtgtccagctccgcgccgagcagctcctcgagctgattgagcttgccgatgggcttcttttcctgatacttacgcattacatccgcgaacatgagctggttggcctgtccgtgcgggatgtgatgcacgccgccgagcggatatgccatcgcgtgaacagccgcgcagccggcatgaccgaacgcgatacctgcgtagttggaggcgcgcagaaactcaagtgcatgcttcttccacgcatccttgccgcccgctgcaacagcgtccttccagcaggacaggataaggtgcagcgccttttcggagaacagctcgctgagcgcacaggcgttcggagacaggtagctttcgaccgcgtgaaccatcgcatcgatggaagaagtcgcgaacaccggatacggcaggctgagcagcatgcccggcacgagcgccgcttcgtccgcaaacatcgccggagacaccaaaccgaccttgacgcccttagttgtacggttgatgatggaaatgttggtaacctcggagccggtgccgcaggtagtcggcacgatgatcagctcatgctccttctcgaggtttgccatgcggtcgtacagatcgtccacacggtcagtggacttggcaacggtcagcacctttgcgatgtcgatgacggtgccgccgccgaccgcgataatgcggtcaaactccttgccgcgcaggtcatcgaggatggcgtcaaccataacgtcggtcggctcaccgccgccaaacttttcctgaaaacaggtatggcagccgagattcagcgccgcaatcgtcggattgtagatatattcgttcgtcaggatcaggtcgcgcgcgccgagcttcagctctttcgccagcgtgcggaaatccatatattccgcgatagagggaacgatcttgaatgctttcatgccgcttgcctcccttaaatgtccgggaaatacttcgcgtcggccttagttacccactcatactcgggcacaacggtcgtcacgatgttcttgtcgtcctgcagacggatgcaccacaggtaatactccgcatagccgggcgcagcggcctgagagtgcgttacattttccggcatgccggtcaggtcgttgttcttaaccttgaaggcatcgtcgccatattctgccagaccgtagccgttttccggcaggaacttgtagtagtacagctccggctcaacgtgctgatgcggcggataagaggaccacttgccggggaaatgcaccacttcaccgataaagaagttggtttccgggcagttggagcggtcaaagaacgtgcgcaccagacgggtcgaacactcgttcatctgaccggcgccacgctcctcattcgcgcacaggcagtcctccggacgcagcagacgagccgcgaaatcgcgcttgttttccgtgcgggatactgcaatctccgcgtcactctcggcagagatggtcactctggtattctgcggcacatgcagcaggatcgcaccctcgtggaacacgtctttgcgggtaacggtctcggaattgccgttccatgcgaaggtcacgctaccgctcatcaggtcgtaaacgacctcctgcgcatagtcgaagtgcatcacatcgccggctgccatcttgaccacgccgaactccatgcccatcatttccggatgctcaactgccgaaaccatgccgttatagcccttatcgaagggggccttgtgcgtatatttcataattcttgctcctcttttctttgctctataccagattgcgtatctataccttatatgcaagatatgcaaggaaagccgcccgtccgaaaacgggcggctcgtattgaatctgcgtttaattagtacatgcgtgcttctgccagatgatcgtcgatgcgcttgcgtgcagcctttacctcatcagacttggaggtagatgccacgccgatgtgccaccaggactcgtagccctccgccatggtcttgggcagaacctttgcgtcgatgatgcaggaaacgctttccttcttagcatcctgaacggccttgcggaattcgtccggagtctttgcgtagaacgccttcatgccgaagccctcaccgatcttgccgaagtcggtgtagcagtagtcgccgtccagcttgccggtggtctcgttgcggtgacgcatttcggtcgccagagagccaacgccgttgcccatctgcaggttgttgatgcagccgaatgcgcagttgtcgaatacaacaacggtgatcttcgcgttctcctgcattgcggtcgggatctcggagttgagcatcataaaggagccgtcaccaaccagagcgtaaacttccttatccggctcagccagcttggcgccgaacgcaccggcaatctcgtagcccatgcaggaagcgccgtattccatattgtaggagttcggtgcgtcggttacccacagacgctcgaggtcagccggcagcgagcctgctgctgcaaccacgattgcgtcgtcgtctgcctcctcacggaggatgccgactgcgttggactcggtgatggtgccgccgatctggtcaacgaaatcgttcatgatcttctcggtccagctcggtacgcacggtacgaacttgccctcgccgaagccctcgcccttgtactgaacgcccagaacgcgcagacgctcttcttcccaaaccttgcggatatcctgaatttcggtggtgtagccggacttgtaaccgtctgccttgagctttgccatgatcgcttcgagagtaacctttgcgtcgccgatgcagcgggttgcgtccagcttttccgcgtggaactcggaagtattgattgccagaaccttaatatccgggttgcggaacagcacccacttggagccggttacgaagtcgttgaaacgagtgccgacaccgataacaaggtcacagtccttgcagagtgcgttcgccgccagaccgccggttacgccgatgccgccgacagccagctcgaacgaatccggcaggcaggaatggccggcctgggtctgagaaaccggaatgttgaacgtcttgcagaagtccattgcggtctgaccggcctcggagtaacgaacgccgccgcctgcaatgaacatcggcttcttggaagccttgatcatctcaactgccttctcgatatcgtaatcatccgctacgcggcgtgcaacgtgatgtacgcgcttctggaagaagtaatccggaaaatcgaagctctcaccctgcacatcctgcggcagcgagataactgccgtgccgcagtttgcggtgtcggtcaggacgcgcattgcattgaccatcgcgctcatcagctgctccggacgggaaatgcgatcccagtacttagcaaccggcttgaagcagtccgaagcggacatggacaggtcgttcggaacctcgagctgctggagaaccggatccggctgacgggttgcgaagtaatcggacgggaacagcagcagcgggatgttgttgatggtagcggtcagtgctgcagttaccatgttcgctgcgccaacgccgatggacgaggtgcaggcgatgatcttgcgacggttgtgctgctttgcgtagctgatggcggcgtgcgccatgccctgctcgttgcggccctggtaaactctcaggtggcccggatcctcttccagcgcctgtccgagaccgactaccatgccgtgaccgaagatcgtgaacatgccgtctacgaagggttcctctttgccgtccatctcgatgtactgctggttcaggaacttgacgatcgcctgaccgactgtcattctggttttgctcattgtgttttcctcctcaaatgctttactcatttctttcctgccgaggctctttcttttcgctcccggcggtgttctcttttgatgatttaagtttagcatttgagggtttgcttttcttctaacatcttgaggaattgccttttttcttatatttttacgttacatacaaatattttcacattttattatagaatccagaacttttctctcccctatcgcattattttccgtgcctgccgctcccgcttgcggtctgtgctttgcacctgtttttttaatatctcgctatcgtgcggaaaatgcggcatgctgccattgcagaatttcacattttccgtcccacataacaagcaaaaaagcacatatctcaacattttataaaaatacgcaactttttgtgagtttccttcttttccctttccgtggcattttcccctgtttttacaggatgttgctgcgttttcccggctgttcggcggcttcagcgcctcagcttatacgttcttgcggaactgtcggaaatacaagaagttagaagaaatcgcaccacccgcctgttacaatagaatcatcaaaacaaaccgcatccgcggcagaaaaaggagcgattctcatgttgtttgccatcttctcgacggtggtcattttcctgaatatgtacctgacggcgtccctcacctgtacgtcgtacccggatcgttccgattatgactacctctgatccgttatcccaatttttgaacatatcctaattctctctcacttttcggcgcagccttactctctcggctgcgccgagcgtttttttctccggcattttctgcgtatccttgcaaaacaaaaaggtcatcgtttccaatgaaacgatgaccttagtctgtcaaaaaacggtgacaggctttttatttccgtctgcgtctgggcttttcctccgtgccgctgggcacgatgtaattctggcggaacttgttcggcggcatgccgacgtttttggtaaattgcagattgaaatagctctgcgtatcataaccgaccatctccgcgatgcgggtgatggacaaatccgtggtgatgagcagcgtctgcgcctctccgatccggcggcgcagcagatactgcactggcgagtagccgctcatctgcttgaacacatgggataagtaatacgagctgatatgcagtgcctctcccatgctatgcagcgtgatcggctccatatagtgcttgtcgatatactctttaatgcgccgtccgaggatatgcggctcgtccaccggcttttccttggggatgttcacgctgtccgtcacggtgaggacagccaccagcagtgcgtgcatcagcgtgctgcaaaacagctccgcctgcggctcgcccgctgccagattgcggaacatcatctcaaacagtgccttgagatcgttgaaatactttccggtcgggaatacatagcccgcatcatccggaatcagcgcgttttcccgcagaccgggcatatgcagtccgcccactgccacgcagtagctgccgacctccatatccggcccggagatctcatcatgcaccacgcctgcattgtacaccagcagatccccggcctgaatgaccacctttttatcgtggatcagatactcgctcgatccgctgcagatcagaatcagctcgacaaaatcctcgtgtgcgtgcatcacacgcgggtgcgtgctcgcatccggccggatctcgctgacataaagcagcttgggatgattctcgccggaatcacggaaaatcgtctttacttccttttctacaaaacactgcacattcaagctcggcttggacatgtttggttgcgctcctctctttttcctcagataataaccgcataatggaacaaagccacagctttcattatgcggtactgtcttttcttttactttaagtatagcacgcaatccggctttgcgatagcacgagattgcttttgcccaacaccatatcctgcggttttcttttgcagcaacggtgtttttatggtttcttgctattttacggattcttgttttcctccgtatgggtcatgctctgccggaacgactgacggaatcttccgggcggtgtgccggtatattttttgaacatcgcattaaaatgacagatactgctgaatccgagcgtatccgcgatctccgcaatgggcgtttccgtgtgcattagaatgccctgcgcttctccgatccggcgcttcatcacatactgcatgggcggcacgccgaactcctgcttgaacacatgcgccagataatactcgctcacgcgcagctgctcggccaccatacgcagagtgatcggctcccgatgatgggaatccagaaaacgccgcacgcgatgcgccagcacagacgggatctgactaccgtcgttttcacgctgctgcacgcggctgcacagcagcgcatcggtcagattgagcatcgcctctgccagactgctgcataccgcacccagattgtccgtatccgcactgagcagatacagcagccgcatggtttctcccacctgcgcagcaagctgtccgcaggacaccaccggatactcccccgcagcgatcagacaattgggcggcagcccctcgacctgcacgccggtcagcgccacgctgtacgaacggatctgccgcacctgttccggctcctcgccgtgcagcacgccctgattgcagatgacgatatcgcccttcccgatcggataatatcggttgtccaccatatactgtccgtttccgctgcacacataaaacagctccagacggttttcgtgtatgtggggcaggatggactgtcggttgttgtcattgcgatcgatcgcaacacagttgacaaagctcccgcttcgcttttttgacttgttctccatagctgtttcctcccaataatcgcaagattacgaaaatccttccgtgattttctgcggtacaggtcggaatctgtgctgtttttccacaagaacccgccaacgcggttttgcattttttcgtataataattacaagaaaagcgtaaaacacttcaaaaaagcagtttacagagcagatttgtttatgccaaataacactgtcgttctgtctgtgaattcattataccataattgcacagaagaaaacttctaaaatcctgctttttgaggccgcgcggtaaatcactacctgtgagtaaaaaggagtgcagaaaaaaatgggaaacaaagtaaaaatcggtctgctgggtgcaggcagaatcggcaaactgcatggtgaaaatctggcacatgccgtaccgaacgctgatctgtacgcagtttccgatccttgcagaatgcagagcagacccttgcggaacgcatccggcgtgtggaaaatctgcgccgcacgatcgagaaacagtggcaggcgaactgcggcttttcgcgtgaaatgtccaaggcactggtgaaccgcatcgttgtggacgcagacgagagcaagacctgtatcactctggatgtttttctcaccgccggtcgagagtcctgcacggattcggtgcttcccgccgcacaatcctcggatgcaccgctgaaactgacctttccgcgtccgcgctccggtcatcagggcgggtatgaggtgacgtatcttgtgcggtggcatctggatcgaaacgccccatttccccatgaaaaaaagcgctgttctccgaagaaaacagcgctgaagcgcaatcctctattttacacctgcttcaccgaatccccctgcaccagctcggtgggaaccagaaagcgcagcggatcgtattcctccccgcagacaaacgaaatcagcttgcgaatgctcagctctgcctgctgacgacagtgcacatcaatcgaagtcagggacggcagcgccatttttccgaggggattattatccacgccgaccagcgaaacctcgccgggcaccgaaaccccgcgcaggaacagcgcctttgccgcgccgacacccagatagtcgttcgcgcagaagaacgcatccggtagctcgtccacctgatccagtgcacggccaatcgtctgcggaatatccgcatcatccgcactgggcgtcagcagcaggtgctgcggatcgcacggcagaccgaaccgccgcaaggcgctgcggaagccgtcataccgttctccgaatgccgtggaatacatcggatcaccgataaaacccattttgcggcagccatgggtatacaaatgctgcactgcctgatatgccgcctctgtattgtcctcaatataggtgcacacacgcagggcatgatagcgtgttcccaccgccacgaccggcagtccgcacgatacgatattagccgccagcgtttcttccatgtctccgaggatcaaaacaccgctgatctcgctttccgtcagccaccgacgcagcgcctgcggatcgcgatcccagtattcgtgatcgaaaaccatcatttgatagccgtgctcatatgccatccccagaaacaacttctggaacgccacatagaagtaggaatccttcagatgtgcgccggtcgagatcagccccagcttttgggacggtgtgcgatggcttttatgtgcataataccccagctctgccgcaatgccgcaaatccgggcgcgcgtatcaggattgacgtttggcatatcccgcagggccagcgatacggtattgatggaaacacctgcccgctccgcgatctgtttcaatgtaacttttgccatgacgcattccccatttgtttaaaaaaataaaaccgttatcagttcactttcatattaaagtactgcgccgctgatgtcaaggggcagcaaaaccgtaaatcagccccaccgctggggatacggatccgcggttcccgcgcgctgtttatcggtactgcggctgcatttctgcacagataccgagtgccagcgcgcatttgtcatattatgtatcggcaaattttatattaaatcattaggaaaatatacggattaaccaaatatttttaatattaaaaattgtttacctgcataaaagtatgatttttaccgttctttttcaaaaccgcaccattaaccgcatccgttttgtatcaaaacccgctgtttttcacaaaaatcgcttcacttgacatcagaaaataatatgataaaatgtgtttgtaagcagaaaaatcatatcgcaaatccccactatttcgttttttataatattaaaaagctgtctgccgccagagcggaaaggaggatcccacaacaaatacgcagtcgtaagcgcctgtaaaattttcctgaaaaagactgcgaggcggcgaaaagagcaagcacaatatgataaagagtaaaattatagagaaagaaggagaaatcaacatatgctttttactgctgtaaccttcattgcgttcactgcgctcgtcgctgtcattgcatggtggcgcacgcgcgacgatgacctgagtacacaggacggttattttcttgcgggccgcagcctgacaggaccggtaatcgccggctccctgatgctgaccaacctgtccaccgagcagctgatcggtcagaccggccagagcttttcgaccaacatgggaccgatcgcctgggaagtcacctcagcagcagcacttgtcattctggcgctggtatttctgccgcgctatctcaagatgggactgactaccgtaccggaattcctcgaaaaccgctacgacagcacaaccaagcgtatcgtttccatcatgttcctgctcggctacttgctcacctacctgccgaccgttctgtattcgggcgcactggtgttcaaccagatcttcgaagttgataagcgcatgggtgtatcgcagatgcagggtgttatcatcacagctgttgccatcggtatcgtcggcgcctgctacgccatcttcggcggcctgaaggcggttgcggtatcggataccatcaacggcatcggactgatcatcggcggctttatgatcccgatcttcagtctgctgctgctcggcaatgacaactttctcgccggtctgcgcgatctgatctcggtcgtaccggcagaaaagttcaacgccatcaatccggcccacgcaatggcgccgatgattccatggccggtgctctttaccggcatggtcgtcaacaatatgttctactggtgcaccaatcaggcgatcattcaacgaacgctgggtgcaaagaacctgtgcgaagcacagcgcggtgcaatctttgcaggcttcctcaagtgctgcggcccgttcttcatcaccatctgcggcctgatctgctaccgtatgtcgatggatcccgctgagggcttcttctccgcggagcacatcgcaaatctggcaaagaccagcgaccttgcctatccgacgctcatcctgaacgtcctgcccaagccgctgctcggcttcttcgcagccgtgctgttcggcgcgatcctgtcgtcctttaactcggcgctcaactcttcggtcacgctgtacacactggatattcaccgcccgctgttcaatccgcaggcaacggacgcacagctggtccgcatcggcaagatcttcggcaccgtgcttgccatcgtttcgatctgcgtggcgccggtcgtcagctttgccccctccggtctgtatgactttctccagtcctgcttcggcttcttcaacgtgccgattctggcggcggtcatcgtcggtatgttcacccgaaatgttcccgctcgtgccgccaaggtatcgatcgtgatgcacgttgttctgtactccatttccaaattcatccctgcactccagaatgtgcactatctgtacgttcttgcggtactgttcgtactgaatgttgcggtcatgctgctgatcggcaggatcagcccgcgtgcaacgccgtacgtcatgcaggatgtcggcgctgtcgatctgacaccgtggaaataccgcaagattgctgccatcggtgcactgtgcctgatgtgctgcgtttacctgctgttctctcccctcggccttgccggctgatgagatagatccgcccgcaccgctgaccgtttcccacagcggtgcacaggcggcaacctaaaataccaacaaaaaacatactgaaatctctgtaaacaaagaaaggatgctgttaccatggcaaaaactttaaaaatcggttcggtcggtctgggtcgtctgggctatgagcacgcaaagaatatcgcaaactatgtcaccggcgcagagctgaccgcaatctgcgacacggacgcagcgcgcgtagcacaggtagccgaggagctgaacgttccctacacctacacggacgtagctgagatggtcaaaaacccggagctggatgcgatcgttgtcgtttcgccctccatgttccatgccgagcacatcaagctcgcactggatgcaggcaagcactgcttctgcgacaagccgctcgacacgacggttgaaaagtgcaagctggcagaaaaggctgtggaagcacatccggacaaggtattcatgctcggcttcatgcgccgctttgacgattcctacgcagaggccaagcgccgcatcgacgcaggcgacatcggcaaggtcgttctcgtccgctcctacacgcaggacccccgcaccaccatcgagggtacgctcaagtttgcaccgcactccggcggccagtatctggatatgtgcgtgcatgacctcgacctgatccgctggttcaccggcgcagaggtcaagcgcgtctgggcgatcggcggcgtattcgagtttgacctgtaccgcgagctgaacgacgcagacaactgctgtgcgaccgtacagctggacaacggcgcaatgggcttcatgtttaccaaccgcacccacggcgcaggctgcaacgtagaaaccgagatcattggcacgcacggcacgctgcgtattgcaaatgtcggcgcaaagaacctgctccagatcgtagacggctccggcgcacgcgaggagtactatccggacttcctcagccgctggcatcaggcctatatcaacgagatccaggagttcgtatcctgcatcaacgagggccgcaagcccggtgtcaccgtttacgacggcaccaaggtttctcaggcggcataccgctgcaaggaatcctttgagaccggcgaaatgctagtgaacgaataatcaccttttcagaacgggggcgggcagagaacgcatctgtccgcccggtaccatcattcattttgtttcccaagataccggaaggaggactctgacatgagcaaggaaatcaaagtcggtgtcatcggctgcggtgcgattggcagacagcatatcgcacgcctgatgaacacgattcccgaaacgcgcgtagttgccgttgcggattattaccagccgtcggcacaagcggttgcagaacagtacggcatcacctgctgcgcgaccggcgaagagctgatcgcacgccccgaagtagaggctgtgctcgtcacatccgcagacccgtcccatgcgggctatgtgcttgaatgcatcaaggcgggcaaattcgtattctgtgaaaagccgctggcacagaccgcacaggaatgcgaggagatcatccgcgcagaggttgcaggcggcagacggttggtgcaggtcggcttcatgcgccgttatgaccgcggctatgctgccatgaagcaggcgatcgagtccggtgagatcggtgcgccgctgatgatccactcgtgccatcgcaatatgtctcaggcacccggctttgcgaccgactacgcagtaacgcgtgttgcgattcacgaaattgatatttcccgctggctgctggacgatgaatacgctacggcacaggtgctggcagtccgtcaaagcaaaaacacacagggtgactggctcaacccgcagatcatgatgctgaccacccgctcgggacagcgcatcgatgtcgaggtgcagaccgacggcgcatatgcctatgacattcagtgtcaggtagtcggtgaggatggtacggtcagcctgcccgatccgtcggctgtggtcaagcgcgcgggtgcagcctgcagcttcccgatcatgaccgactggtcgcagcgttttatcgaagcgtacgacatcgagttcgatgcatgggccaaggcgctgctgaacggcgcaccggacggtccgtccgcatgggatggctacgttgcctgtgtcaccggcgatgcactcattctctcccgccagaccggcaagccggaagcgatcgagctgatggaaaagccgtccatctactaatggatttccgcctaaacctatttccattttttcatgccctgcgtatcgcaatgcgtgcgcagggcatccttttgttgtttttcctatgccgttccgccaaagaaatgaacggaccaaacagatcaacaactctgcaaataaaaaagacagctctcgctgtcttttttgtctgtcggaaaatgcctcgcggcgcggcgcatatggaatagagcattgcgaccgcagggcacagcctttcatcgaatttcgatcgaaagcgtggtttcgattgagaggctattgcatcatccaaataggatggacgaaacacagattttcctcctgtcagaacgcgatcgcgcgttcggtctgcttatcgaacaaatggatgcggctcatatccacagccgcggtaatggtgtcgcccgcatgaatcggctcaccgggcggatctatagccgtcaaacccgaagtgcgtcggcagcgaaatgccgttcgacaggatctccgcattcgtcttgaacgaggacaggatgacccagatgatcgggaacagcgcaacgaccacgcacagcgccataaacagatatttgagcacaaagcacaggcgttctctgccggtcattgcaccgaagctggttttcatttgtcgaacgcttccttagtagtcttcttcgttgacgcgcatcgccttgttgatgagcgtcatgcaaacaaagatagaaaaaacaccgtgcaaagcgttactgctctgcacggtgttttccgttttacgattccttttcttcactttttcctttttcgctgtgcgtgatgctctgcttgaatgactgccggaacttgccgggcggtgtgccggtgtacttcttaaacatggcgttgaaatgacagatactgctgaagccgagtgtatccgcaatctcagcgatcgggatgccggtattcatcagaaaaccctgcgcctcaccaatccggcgtttcatcacatactgcataggcggcacgccgaactcctgcttaaacacatgcgccagataatactcgctcacgtgcagtcgctccgccaccatacgcagcgtgatcgactcacagtggtgtgcatccagatagcgccgcacgcggtgcgccagcacagacggcatttcacgctgctgctcctgctggtggatacgactgcggagcagggaatcggtcagattcagcattgcctctgccagactgcagcacacggcatgcaggtttcccgcatcggcgctgagcagatacagcaggtgcatggtctcgcctacctgcctggcaagctgtccgcacgagacgaccggacactccccttctgcgatcagacagttgggcggcagaccttctgcattgacatcggtaattgcgacgctgtacgaccggatctgccgcacctgatcgggttcctcgccgtgcagcacaccctgattgcagataacaatgtcgccctctccaatcgggtaataccggttatccaccatgtactgtccttgtccgctgcacacatagaacagctccagacggttgtcgtgcatatgcggaagtatagactgctggttgttgtaattgcggtcgatcgaaatgcagttgaagaatgttccgctcagtttacgcggcttgttttccatgtatgctccctcctaagaatcacaagattacgaaagcctttcctcgattttctttcttccactcggaaaatcctgctgttttttccacaagaacacgataacgctctcacaggctttgtttgtataataatcacaagaaaagcgcaaacgattcaaaaacagcagtttatatcgttgttttattcgatatttttacatcgttcttctctgtgtgcaattattatatcataaaaacacagaaaaaaacttctaacatactgctttttgagcaagcgcgtcaattcaggtttcagagtaaaaaaggagtgcaagaaaaatggcaaacaaggtaagaatcggtctgctgggtgcaggcagaatcggcaagctgcacggcgaaaatctggcacatgccgtgccgaacgcagacctctacgcagtggctgatccgttcatgaacgatgcgacccgcgcatgggcagcggacatgggtattgagaagtgttacgacgatcccgagatgatctttggcgatccgaccatcgaggccgtgttcatctgctcatccaccgcaacgcatgcagacttcatcatgcgcgctgcgcagaccggcaagcacatcttctgtgagaagccgatcgacaccaagctggcaaagatcgaggaagccctcgctgcggtaaagaaggcaggcgttaagctgcaggtcggcttcgttcgccgctttgaccacaaccacaaggccgtccgcgatacggtcgcttccggcaagctgggcaagcccaatctcatcaaggtcacctcccgcgatcccgatcaccagccgatgagctatatcaaggtttccggcggtatcttcatggacatgaccattcacgatttcgacatggtgcgctatctggcaggcagcgaggttaccgaggttaccgcttacggtgcagcgctttccggcgccggctacgaggagtacggtgacgtggataccgcaatcgtcatgctgaagtttgagaacggcgcactcggtgtgatcgacaactcccgtgccgcacactacggctacgaccagcgcaccgaggttcactgcgaccagggctgcgtgcaggttgcaaacgatctgaacaacaccgccatgatctcctctgccgcaggcgtcgaggttgcaaagccgacctggttcttcctcgagcgctacaacaacgcattcatcgcagaggcaaaggcattcaccgatgccgttctgaacgacaccgacacgctggtaaccggttttgacggtctgcagccggttaagatcgccatggcggcaaacctgtccatgaaggaaggccgtccggtcaagctgagcgaaatcgagtaatttatccccgcattaccacaagcaaagagaagagaaagagttaaggcaagccgccgcacccggcggcggcttccgttttctgagaagagaaagaggggttgctccttatgagtgaaaagaacaacactgcctcccttggctggggaacccgcattgcctatggtttaggtgacactgcctgcaacgttgtgttcggcatgatcaccgcgctgctcaccctgttctatacggattactgcggtattccggtcgttaccgtcggtctggtcatgctgatctcgcgtatttttgacggctcgtccgacgttatcatgggcatcatcgtgagcaagaccaaatcaaaatggggtaaggcccgtccgtggattttatggatgagcgtaccgtatgttctgtgcgcggttgcgatgttctgtgtgccgcacagcagcacaaccgttcagttctggtacatttttgttacttataacctgtgcaccaccgtatgctacaccgcaatcaacgtgccctacggcaccctgtccaccatgatgacccgctcctcgcacgagcgcgacctgctgtccgttgtgcgtatggcgctgtctccggtcggcaagatcattgctgttacgttcaccatgccggtcgtcaagctgttcggcgacaatcaggccgcctggatcaagaccatgagcatctggtgcgccattgcacttattctgctcgtcatctgctttgtacgctgcaaggaaaccgttaatttcgaggccgcgcagcaggagcagcccaaggttcccgtttcccgcgcgattaaagcgctgcttggcaatccgtatttctgggcaacgctcattctgtggactgtcacctgcgttcataccaccatcatcggcaccgacctgccgtactactgcaaatatgttctcggcaacgatgaatggtattacagcgtcatttacacctccgagatcgtcgcactgatcgttggcgcgctgctgtgtccgatgctgctgcagaaattcaacaagcgcaacctgtcgctcgccggctgtatcgtagttgttatcgcccatgccctcattatggtaaacccgatgagcttccggtggattctggtaatgaccatcatccgctcgctcggtcaggctccgctgacctctctggtattcggcatgatgggcgatgttgtagagtacggtcagtggaagagccatctgcgtcaggaaagcctgatcttcggcggcggctcgctcggctttaagatcggcaccggcatcaccagtgcggttatgaccgccatgctcgagggcgcaggcttcctcagctcggttaccggcggtgccatgcagccgacttctgcccagcaaatgatttcctctatctttaggatcggtccgatcctcgtttggatcgttgcaattatcgtcctgctgttctacaagctggataagatttaccccactattatgaaggaactcaccgagcgtgaagcgcgcggtgaaatgtaaaggagactgttttatgctgaaactcggatataacgaagcaacctgcaaggaaaattccacggttgaaaacgacctcctgctgtgtgaaaagtacggctatgactatatcgagctgcgtcttgatatgctgcaggagtatctcaagacccacaccgtggacgatctcaaggctttttttgcaaagagccatatcaagccgtttgcattcaactccattgaaaacatcaacttctgcacgccggaggagtgggaaaagctcgtagagctgttcaccttcggctgcaaggtggcacagcagatcggcaatccgtatatcatcgtggtgccgactgtcaccaatgagatctgcaccaggaacgagaaggagattttcgacgactcggtgaaggtgctgaacgaactcgccgacattgccgagccgtacggtgtcaagctgtccttcgagccgatcggcgacaagaagtggtgcgtcaacagcgtacgtcaggcgctcgagatcgtaaacgccgtaaaccgcgacagcgttggtctgaccgtggactgcatcaatgtttacctgcacgacaagtgcgcggacgttgatttcatccgcaaaattcccaaggagaagctgttcgtgttccacatcaacgactgcgaggacctgccgctcggcatcctcgaccactgtcaccgtctgatgcccggcctgggtgccattccggtgcaggaggttgctgatgcggtacaggcagtcggctacgacggccctgcgtgcctcgaactgttccgtccggaatactggagaatgcctgctgaggatgtgatccgcatgggcgcggaaaccacccgtccgttcctcggttaattttcccgaatcgcagattcattccatattcacacccaaagagcacagcagtatatcaggacccgaagaagctgtgcgctgacccgaacgtcgaggcggttgccatcatcccaatactgcatctcatgttgagaccgaaatcgttggtacccgcagcacgctgcgtatcgtatccgttccgactgattctccggtcgaggttatgagccggtacggtatctgccgcgtgtgctatactgcattcttatttcacattcaatttattctctattatttatattcaagtctccaaacagaatacaaatataattttctccgcaaaaggacagaaggtacttggacccttctgtccttttgctttccatcacatcagacaatcctgcaaagaaccccaaagagcgctctttcgagcgccctttggggttatggaaagacctgactttcgtcagaccgatcgcacaattttctttatcgcagcgtgagcactatcagcacgactgccgacacgctcaacacaaggccgataatgcgcgtcagccgcgttacaccgcggatgctcatcgcgtgaaagctctcaaacgaggtgaccggatacggaaatgcgataaacgccagtcccgcaacaagctgaccggcatacgcaccgatcatgcgcagcgaactgtcaccgccgaaaaatgcactgataacaaatccgatgccgcccagaaagaccagaagatacagtgcggtcttgaatcgcttatccagcttgatatactgttcggtcttttccgcacaatccgcacagcacacctcaaacgagcgtgtgcgcacctttgatataatatttatatgtatgaatgattaagccgcccgcatcacggcaatcctaactaccagaaggaggaatttccatgaccaacaactttcagtgtgcacagatctaccagattcttgcgctcaacgatgaaatgctgaagagcggctgcatcacccgcgacgagcacgattttgtccgccatgtgcagacggacaagctgacccggctgcacagcacgccgtaaggaggctgtctgatggacgtccgcagactggacgaaatgcaggcgcagggccgcagcatcttcgataccgagcttgctgtggcgtactatgcccgcgtgtcgaccgacaaagacgagcagatcaacagtctcggcaaccaaaaacgctattttgaggactatatcgccgcaaatccgcactggaggtttgccggcggctacgtcgatgagggcatcagcggcacgtctgtcgagggacgtgagcagtttctcaagatgatcgaggacgcgaaacgcggccgctttgacctcatcgtcaccaaggagatcagccgtttcgccagaaatacactcgacagcctgcgctacacgcgcgagctgctgcgctgcggcgtgggcgtgtactttcagaacgacaacatcaacacctttgacaaggatgccgaactgcggctcaccatcatgtcctccatcgcacaggacgaggtgcgcaagctgtccgagcgcacgcgcttcggctttaagcgtgcgcaggagaacagcgtgctgctcggtcagaacaatctgttcgggtacaacaaggttgacgggcgattggagattgtcgagccggaagccgccgtcgtccgtgaggtgttcgagcgctacgctgccggagacctcggtctccgcgccattgccaacgacctggacagccgcggtgtacgcggacggcacggaaaaccgctcacctactccacgctgtacggcatgatccgcaacccgaaatacaagggctgctatgccggtcggcggtacgcctcgcgcgactaccgcgacaaacgcagctaccgcctgagtgcagacaaatggctcgtgcataaggacgaccgtgtgcctgctatcgtgcccgaagcgctgtgggagcaggctaaccgtctgctcgcctcgcgcggcaagaccatgaaggcgcacgcgcaggcatcccagaaccgctacgcctacagcggcaagctgatctgtgccaggcacggcacaactttccacaggcatgtgtataaaagcaaaagccgcggcgagtcggaatgctggaactgcaaactgtaccgcgaaaagggaaaacagggcggctgcgactcccccacagtttacagccacgagctggaccgcattttggagcgtgtgttcgagcagataacggacgagcgctcagccgccgtgcaggagtacatcgacaatctgcgcgcctttgccgcacagcaggataacgcgcctgcccttgctcaagtcgagcaggaaatcgaaaccgtcacccgccgcaaggacaagctgctcgatctcgcgcttgcgggtgcgctctccaacgacgagttcaaacagcgcaacgagacctgcaacgagcagcttgccgccctcgagcagcagcgaacagaactacagaacgcagacaagacactggaagaacgtatccgacgggtggaaaatctgcgccgcatcatcgaggaacggtggcagaggagctgcgggttctcgcgcgagatgtccaaggcgctcgttgaccatatcatcgtagactcggacgagagcaaaacccgtatctcgctcgatattttcctcaccaccggtgcagagccgatcgtatctgagacgcaaacctctaactcacagctgcaaatgagctttcagcgggcgcggtcggggtatcagggcacgtatgaggtgcggtactgtgtgcggtggcaccttgggtagcagacgaaaaaacagcaaacctgcaaggtttgctgttttcttttttcaaaacttttcttttattatttcccgcttatcttgacagaaccgccattttgcagtacgataaggccagaaatcaaaatcaccctaagtattacatcctttcgtttgatgagatacacatctcacaggcacaggtatcccgtttggaaaagggcgcactggagcatatccgcaagcaaatttaacaaattgaaaatggataatggaggatggaaaatgaaagaagccgcccgaagggcggttattgaataaacgtgctttgcgcgttaccgaaattctcaattttcaattctccatgctcaatgaaagaaaaaacagcaagtccaactgaacttgctgtttttctttacgctgcctgactttcgccggaggcataatcaatttccacgcccggctggacgttatagcagtacacgttaaagcaaatgccttcgccgtcatcctcgaccgaccacgcctccatctgcacgcccgaggcgacaagattgctcccctcaaacaccggcgtgacccgatagagcacatggttgccggtttcctttacatagtcagcgaccatattctcaaacggcagcataccctcgatattgaggtatcgcgtgccggtgatcaggttctgcttgttggcattctcggcggtaagctgccagccgatcaggtgacagcggttatacagatatttgccgtccacgcagtcatacttgaccgtatgccatccggttggcttgacctgaccgatcgaaccgcgtttttctccatctgcgggcatcagctcctgtccgacattggcgtatgccgtgccgcaccgtccgagataatccaaatccgaatattcctcaaacgcttcggtctcctgcttgtctgcgtcggtgaaggacggctggttgccgtcgatctcgacataagcggaatccgagtaggcgggcagctcgtccatcgaaaccatactgctcgacggcatgggcagtgcacagccggaaagcagcaggctgagcacgaatacaatcggcgcaaacgcgcgggtcaattttcgcatttaacaaatacttcctctgttattttttcatgcgaggaaccggcaaattcggtttcgctctgctttgtccatccggtttccggcagggtgaaataccggtcggcgggatagacacgattccagtgatataatatcacctgctgcaccctgtttaagtatggtgcaggattgtgcacctcagcgaagcagtaatcgtcctcttccgcccgctcgaggcaatcctcagcgatgcaaagccgtactgccgtatcctctccgaacagctttgcggtgtacggacttatccacagtctgtgtataccgcagtgcataagaatgcgctcattcagcacacgatcgcggctctgtcggcgatggttgaaggccaggccgcctttatcatccacacataagatcagcttcatagagttctcccttcatcgggtatcggatgcactgttgaccggcgcaacgctgtatgtaatgcgtcctgccgaaataccctgccgtccgatatacgagcacagcgcttcggtcagtctcggggttgccttgctgtgatgcagccgcacgactaccacgccggacgtggaggcgaaatactgtacggtctgcgtatacgcttccgccgcatttttctcggcatcgccgctgtccagaccggcatcccacaggcggtagcctgcaccgatgagcacgctgcgctgtgcttcggtgagcgcgtcgctgccgctctggttggcggctatgcgggctgcaacaccggtcagcagcgtcaggcgttcgttcgcagcagcaagatccgccagcatgtcggctccgtcggttttgctgtccgcctgcagcagaaaggcgaccgtatgtccctccgctgcgattcgacgaaccagatcatcgtcccatttggaggtatccgtcggcaggaagaatgccgcctgcctgcctgcgtcatgcagattgtccagaacagccgccgtgttttcgttcggcgcgccgtaataggcaagatacacgcggaccggctttttcgccggcttttcctctaccttaggtatttcgatggtatcattgtccactggctttgccggtgcgggattggtattcgtgttattgctgcggtccgactcggaggtactgtccttgtagtcgtcgatcgtgttctcaatcaccttggtatgcgccgcaataaacgccgagtcgctctgtgccgagccgtccgcgacacgcagcacattttccccctgcagggtcagtgaagaataggtaaagccgaacttcgcacagcacagcttgaccggcacataaaccgttccgttcatctcatacgcgggtgtggaatagctgttcagattctggtcgtacacatagccttccgcagtcgaaaagctgagcgtttcgtcgtttgcggaaagatcgagcacgccgtcattctccgaggctgacacgccgagcgtagtaaacacactgtacggcacataggtttcgccgccgagacgcgcaggcatggtgctctcgtcgagcggcaggatggagtcatttatcgctgtcagcgtcaccgcatgcgccggtgcaggcagaaacgtcagcagcagcgcggcacacagcacacagctgatgatttttttgatacgcactcactcctttcagcaattcgtacgaacatattataccaaagcgcagcgggtttgtcaccctttctgccgaaaaacaccttgcgttgtgagaatcgagtgctataataaaagagtacaaattcttataaagaaagagtgaagcaaccatgctgcagatcacaacacagcgcactactactcctaaagcaaagccggacgaaagcaacctcggctttggcgttcattataccgatcacatgctgatcattgaccacgatgaagaacagggctggcacgacgcccgcatcgtaccatatcagccgcttgagcttgatccggcagcgatggttttccattatgcaatggagtcctttgagggtctgaaggcttaccgcaccccggacggctccattcagctgttccgcccggacaagaatgcacagcgtatgatcaacaccaaccatcgtatgtgcctgccgagcctgccggtagaggatttcgttcaggctgtcaaggccattgtttccttcgatcaggactgggttccgcacgctgagggcaccagcctgtacatccgtccgtttgtcatcgctaccgagccgcatctgggcgttcgcacctcccgcacccacaagttcatcatcgtatgctctccggtcggcgcttattactccaccggcatcaatccggttaagatcttcgtcgaggatgagtacactcgtgcctgcccgggcggcaccggcttcaccaagtgcggcggcaactacgctgcatccctgatctctcaggtaaaggcacacgagctgggctacgagcagaccctgtggctggacggcgttgagcacaagtacgttgaggaagtcggctccatgaactgcttcttcaagatcgacggcaccgtttacaccgctccgactgttggcaccgttctgccgggcgttacccgtatgagctgcatcgagctgctcaagcactggggcattccggtatccgaggagcgcctgccgatcgctgacgttatgaaggcttcccatgacggcaagctggaagaggtattcggcaccggtaccgctgcagttatctctccggttggcgagctgcgctacgagggcgatgttgctcacatcaacaacggtgagatcggtgaagttacccacaagctgtacaacaccctgaccggcatccagtggggcaagctgccggatgagctgggctggactgtaaaggtagactgagttatcccgcgtaagcaaaaaaccgaggcgtaaagcctcggtttttttattgcagtaattgagaattgaaaatggaggatggagaattatccctgcgggatacaccatcctgcgtttcattttccattctcaattctccattttccattcatgatatggttcgccgctcagcgttttccatgtaaaaacgccgttttcgagtgtcatatagccatgtgcggtatcatttttcgggatagatactgaacccgggttcagatacaggttttccctgccaaacggctcccatgccggaatatgcgtatgtccgtgcagcagcacatcgcccttacgcagcggcggcggtgtctgggtattgaagatatgcccgtgcgtgacatacaccagccgctcccctgccggcaggacggcatagtccgcgaggattgggaacgtgagcaccatctggtccacctcggtgtcacagttgccgcgtacgcagaggattgtatctgccatgccgttcagcatggcaatcaccttcttgggcgcgtaatcgcgcggcagatcgtttctcggaccgtggtaaagaatatcgccgagcagcagcagacgcgcagcctgctcgcgctcgaacgcctgcagcagctgttcgcagtagtacgccgagccatgaatatcggatgcaatgagaaatttcatgccgcgcctcacttgcctgcctgctttggcacatccacgatggtgccgccgccgacaactacatcgccgtcgtacagcaccgccgcctgaccgatcgctgcggctctttgcggctcatcaaacaccagcttgacacggccgtcctccatcggagaaaccgtcaccggctgctccgcatggcggtagcgaatcttcgccttgatatgaatcggctcggtcagctccggaatcgaaatccagttcatgtcatctacgatcacagtgtccgagaacagcgctgcctccggtccgaccgaaaccgtgttcttctccatatccttgccgcagacgtacaccggctctcccatcgcaagaccgaggccgcgtctctggccgacggtatagcggacagcacccttgtgctttcccaccggcttgccgtctaaatcgaggaaatcgcctgccggatagtgcttgcccgtgtactgctccatgaacttgacgtaatcgccgtccggcacaaagcaaatatcctggctgtcgtgcttgcgtgcgttgcagaagctgagctgctccgccagctcgcggatctccggcttgttgcggtctcccagaggaaatttggtatgcgcaagctgccgctgcgtcatcgtgtacagcacatagctctggtccttgcccgcgtccacgccctttttgagcagccagcggccggtctgttcatcctgctcaatgcgggcgtagtgacccgtgacaacgtaatacaggccgtgctgctcggcaaaatccagcagcttgtcgaacttcataaagcggttgcagtcaatacagggattgggcgtgccgcctgcctcataggtgcggacaaacttgccgatgatcttctcctgaaaatccagtgtaaaatccagtacctcatacggaatatccagctgaaatgcgacctcacttgcgtcctcgatatccttttccgaacagcaggtgcggaaattacatgcgccgagatcctcgttacggtacagccgcatggtcgtgcccatgcagcggaagtccgcctgccgcatcaggtaagccgcgatcgagctgtctacgccgccgctcatcgcaatgagtgcggtcttctgttctgcgttctgcatctgtgccgtcctctctttcgatatattaagtggtaagtaaaattttcatcagatagcaaaaaactccgaaaaccatgtggttttcagagtttttgtggtcgaggtgacaggatttgaacctgcggcctcttcgtcccgaacgaagcgctctaccaagctgagccacacctcgaaatcaagctgtcaacgcttttccgtgacagctttattagtatatcgcagaaatcgctttctgtcaacacttttttgaaattttccttaaattttctcgagcagctttgccaccagacggcgcagctctgcgccgcggcgctcggcagtctcgttgacctcagcgcccgagagcggctgcataagcacgcccgccgccatattggtgatcatggcaataccgatgagcggcagaccgcagtgcgcggctgcaatgacctcgaacacggtggacatgccgaccgcatccgcaccgagcgtgcggaacatgcggatctctgccggtgtctcaaactgcgggccgtttacgccgcagtatacaccctgatgcagcttaagaccgcagtccgcagcggcctgcatggctttttctcccagttcgtggctgtacgcgaacgtcatatccggaaaacgagtaccgagttcgggatcatttttgccggtcagcggacttttgcctgtcatgttgatgtggtcggtgatcagcataaaatcacccgcatgatagccggtgttgatgccgccggaggcattcgtcacgacaagcgccttcacacccaactctttcagcacataaacaggatatgccacctcgtccggcgcgtagccctcgtagccgtgcagacggccctgcatgcagataacgcggcgtccggccagtgtgccgcacaccatgcgtcctgcgtgatcgggcgcggtggataccttaaagtgcggaatctcgccgtagggcacatagaccggtttctccacctcatccgccagcgggccgatgcccgagccgagcaccagcgcgatttcgggcacaaacggcagcttttctttaagatatgctgcagattccactacatttgctttcgtcagcataggtcgtccctccttacagccgacgcaggatagcgtccgtgcgcttctgcgtctccgcctttaccttttcaatgtcgatggtcttgaattcaccatcgcggtacagtacctcgccgtctaccatggtcaggcgaacgtctgcgccctgagccgcatagaccacgttgcaggcggcatcggtcatcggcgtaaactgcggcgtatcggtatcgatgacgcacaagtcggccttatatccaaccgccagcttgccgcagtccgtgcgtccctgcgagagcgcaccggcgcgcgttgcggtgtgcagcacctgcgcaggcgtcagcagcgtggaatcgtgatagaaacccttgtagaccacgccgaacaggtaaatatcctgaaaaatgttcaggttgttgttagaggctgcgccgtccgtgccgagcgcaatattgatgcccttctccagcattttgggaatgttcgcgtagccggatgccagcttgagattgcttgccggacagcaggcgaccgaaacattgtgcttcttgaggatatcgaaatcctcgtcctccagccagacgcagtgcgccgccgtggtcggagaatcgaaaatgccgtgcgcctccatgtacgccgccggcgtcaggccatgacgctgcttgcactcctcgtgctcagtctgcgtctcggacaggtggatgtggatacgcgcacccgcgtccttcgcatgggcggctaccgcctcgaccaccttaggcgtcgaggtatactcgccgtggatgcacagatcaccgaccagacggccgccgttctcgccgttccactcgttcagcaggcgcagattgtccttgtaggcggcaaggctctcgtagtcgctgtcgtcaaatacggtcaggccgcggctgaggttgcacttgatgccgctctcgcggatcgcgggcatcatgccatcgaagaagaaatacatatccgagaacgaaaccgtaccgctcgccagcatttccgcgatggaaagctgcgtaccgtagtacgccgcctcgtcgtcaatcttgtcctcaaatggaaataccttctcacccagccagcgctgcagcggcagattttccgcgtagccgcgcagcagcgtcatcggcgcatggctgtgcacgttgtaaaagccgctcatcaacagacggtgtttgccgtcgtaacgctcgccataatcctcctgcggctcggcatcgccgatgtaggcaatcttgccgtccttcacgccgacgtactgcccgcgtttgcactcaaaattctcatccaacagatcaatgttgcaaaaaagcattgttttctccttttctctttacagaacatggtaatgcgggataatatcctcgtattcgccgtccttattcaaaaatccgccggggatcacgccgagctgggtaaagccgagctttttgtacagcgcgagcgcacccgtgttgctctttaccacagcgttgaactgcaaaacccggaatccgcacgttttgccctgcttcaggcaatgtgtgacgagtttttcaccgatatgctgtccgcgcacggtctttttgacggcatagcttgcgttgcaaatgtgtccgcagcgtcccacattattcgggtgcagaatatacagaccgaccagctcaccggttgccgcgtcgtacgctacgccggtataggtctgctcagtgaaaaaggcatgaccggtcacctcgtccagcttttccatctgcggaaaggctttgccgtcctcaacgacctcgttccaaatttctgctgcctgtgcagcgtcacgctgctcgtactgtcgaatttcgatctgcatggtttctcatccccttgttttaattatagcatagtgcaggagaaaagaaaactgctgcatcgattgcaaactgtagaatgcgccatacccacggcggtgggcaaaaggatggacaccaaggtttccacccttttgaatcccgcttcctttgctcgttagcctgacgcagaccagagaccggcgaccgctccgaaaaggagaacggcagtcgggttactcttgcgtgtctttcgtaacctattcgcagttcacagataccttactgctacacatgcgggttactctccgcaggcgcgacacaccccatgtcgcgcaactcttttacgcgttactacagacagttcctgcgggttacacctatcgacaaactttaccgcagggtgcggcaaggtgaattgcccatcagggcaagagaaggtgccctggggtgcgacctcggcgcaccgtatctaaaccatctgctcattgctaaaacgcaggggcggccattggccgcccacagaatgataacccatcgcgttctctccactcttcacgctttcttaaaacgccgaatacttcaaaatatcttttcgcattcgcgcgataatccgcttttccagccttgaaatgtagctttgcgagatacccagcaaatccgcgacctccttctgcgtcagcgccttcggcgtgccgatgccgaaccgcagcgagatgatctgccgctctctcggcggcaaatggcccagtgcacgatgcagcagcattttgtccacatcgtcctcgagtggccgcatgacgctgtccggctcggtgccgagaatatcactcagcagcagctcgttgccgtcccagtccgaggacagcggctcgtcgatggaaacctcgctccgccgtccggcgatcttgcgcaggtgcatgaggatctcgttctcgatacaccgcgacgcatacgtcgccagcttgacgtttttgtcgctccggtaggtgctcaccgccttgatgagtccgatcgttccaatagaaattaaatcttctgttcccacaccgctcgactcaaacttgcgcgccaggaacaccaccagccgcagattgtgctcgatcagacagttgcgcgccgcaacatcgccgccgctgttcgcctccacagcggcggcctcctcctccggagacaacggcggcggcagaacatcgctgccgccgatataatgtacgccttgcgctcgaaaccgccgcaaaaccatctttaaccactgcagaaatttcattttgctctccctttcacaccccgataagtccctcgtacgcgccctgtccgatggagaccgcactgaccgcacacacacagtcgagtgccgtgccgtccgctctcagcacgctgtccggccggaaatacagcagcagaccgccatccgtgccgaccgcgtgaaacggcagcagaccgcagcgtgcagccagattttccggcagagccgtcagctgcgcggacgcactgccgaacggcagtttcgtgtccagcaggcactcggcggccttgcgctcgagcaccacgaccggctttccggaaaccggttcggtcaggtcgttgcctgtgtcgtgcagcacgcgcacggcggtctgccgagtgccgaaccggatggtcagcgtttctgtttcgcggtgcagcgcgccgtgcttcgcatctccgcacaggagtatcccgcttgccgcgtagccgacagctgccgccagcacgagcacctgtatcggcaccgcaaagtagtacccgcacgagagcagcagccttctaccgcttgcggcactcagcgccgccgccagtccggcgaacgaggccgcgaccacgccgtacagtgcacacagccgcgcaaggtgccgctctctgccgaaagcgatcatgcacagccccagtcctgcaagaaggcgcagcggtgcaagtgtcagcaccggccagaccgcacccagcacggcatagccgccgccgagtgctgctgagaaaatcaaccgcattttccgcacctgcacgccgcctaagcgagccgccgcaagcagcgttgcgccatccatcagcgcgttgacggcaaacagcacatccagatagacgaccatacctcacctcccgaacaagattcagtatagcacggacaacgtgcgcgttttgccgaataaagagcgcaaaatatctgaaaccgctctaccataagatagaacggtttcaggcaaagagtagtatgtaagtaagatgtggttgaaatgagaaaggatataaaagaaaacagcaagagtcctgcacctttatcggtatcagcccccttgctgtgtctttatcatactgcaaaatcgaagatttgtcacctgtcgatttttacaaaatccctagtaattctatcggttatttttggagtgcgtactgtgccagcagctttgctgcgtcctcgacgtcggaaaccgcacacagctcgctcggagaatggatatagcgagtcgggatggagaccgcgcctgcctgcacgcctgcgcgcgccttctgcagcgccgaagtatccgtgccgccgcacagcaggatttcgcgctgcgcggatacaccgcagtctttcgccgcctgctcgagcgcatccacaaccgccggtgtgcagataaccgagcggtccatcaccttgactgccggtcccttgcccagctcgaccgccatcgcggacttcatctccggcaggtcgccggtatcggtcacatccaccgcgatagccgcatccggctcaactgcgaacgctgccgcgcctgcgccgcgcaggccaacctcctcctgtgccgtaaacacgaagtacaggtcgttctcgatttccttgtccgccagctgctccatcatcagcaggagcgtcacgcagccgatacggttgtccagatacggaccgcacagcacgccgttctgctcgaaccgcggtgcctcgtacacagcgaaatcaccgatctgcaccagcttgcgcgcttcctcggcatcctttgcaccgatgtcgatgaacagattatccagcgtcaaatccttaagcggcgtcttttcctcgtaggagatcacgccgcgcgtgccgttggcgaacttcacctgaatattcagcaggtcaccgacatacaggccgccgatctgcgaaaaacggataaagcccttgtcctcaatataggtggcaaccacgccgatagagtccatatgcgcagcaaacagcagctttttgccatcctttgcgccttttttgcggcagataaggttgccgagcgcgtccgtcgtcacgtcgtcgatatacgcgcctgcaatctccgcgatggtttcgcgaaccgcatcctcacggccggaagggccgaatgcacccgcgaccgtgttccataaatcaaaaatcttgctcattcgtcgtcccctccgagttcttccagaaatgcgcgtgcagcggaaagcaccgcttcgcagtcagctactgccgccaccgaggacggcgagtgaatatagcgtaccggagccgcagccgcgcacacgcgcacgcctgcacggctcttgtggatacggcctgcgtccgtgccgccggctacgcgcgttttcgtctgccagcggatgccgcgcttgtcgcaggcattgcgcagaagttcaaacagctccgcatcgtagatagtcgcaccatccatgaacggcagaacgacaccgccgcgtacacggcaaacagcttttccgccttccacctctgcgagatcagcagctgtcgtgccctcgagcaccattgcgaatcccgggtcaagcgcatatgccatgcttgccgcaccgcgcagaccgacttcctcctgcacggtgaagcagaaccaggtgtcgatcggcggctcatcctcgatgagcttgaggagcgcggcacagccgacacggtcgtcaatcgccttggccttgataagaccgtcgccgaactcgacaaccgccgaatcaaacacgccgtaatcgccaagcgaaaccttgtcctcagcggcagctttgctcgctgcaccgatgtcgatatacaaatccttagtcttcggcatggtgcggcgttctgcggcagttgtcagatgaaccgccttgatgccgatcacgccctgcacatcaccgaagcgaaccggtcggccgatgaccacgcgcgggtccacgccgccgacaaagccaaatttcagcatgccgtcatccgtaatcttcttgatgataacgccgacctcatccatgtgcgcgcacagcacaaccggacgctcgagcgcctttttgccctttcggaacaccataatgttgccgatggcatcggttttcatttcatccgcaaacggttttaccttctcgagcacaaactcgcgcaccgcatcctcacagccggacgggccgggcagcgcgcacagctgcttcatcagttcgatcatgcgcccacctccccgtcaaattcgcgcaggaattctgccatcaggtcagcgactgcctgcacatcagacagctccacgacctcgaccggcgtatgcatgtatttttccggaatggacagcagacccattgcgatgccgcggccgacgatctgcatcgtccacgcattcgtgccggtgttgccctccatgatttcaagcgtatagtcgatgtcgttcgccttggcggtcttgatgagcgccttggtgaagccgcggtgcaggttcggacccatgccgactgccacgccgctgccgaggtcgaacacaccgtccgacggaccgtccggcgttctgccgtgggttacgtccaccgcgatggcgtactccggctgaaccgtaaacgcgccggtctgcgcacccagttcagtaacttcctcctgcgtgctgatgagcaccgcgacattgcacttcagcttgtccttcgccgcgtgcagctgctccattgtcagcaggatggcggcaacgcccgctcggtcgtcaaggcacttgctgcaaagctgaccgcccgccagcttgatcggctgctgcgcgaacacgatcggcgtgccgacgcgaatgcggcttttggcatcgagcagaccggtgtcgatggccatctggtcgatgggaacggccttgttctgctcgcccgctttgagcagatgcggcggcatgcaggataccacgccgtacaacggctcgtccgcaagaatggtcacctcaccgccgagcagcatgcgcgggtccacaccgccgaccggcgcgaaccgcagaaagccgccgtccagcacctcggtaacaagaaagccgatctggtcgagatgtgcgtccagcaggacggttttcgcgccctctttaccgcaggacaggctgccgatcacgttgccgttcttgtccgtatccacggtgtcgcagtacggccggaacagctccgcgacggcctttgccgcctgcatttcaaagccgctgacagccggcagtgcacacagcgtccgcagcgtttgttctaactgcaaggaaattcctcctttttcgtcttttgtcgtacaggttctattataaccgtttcattgctcggttacaaggcacagcaaatgaaaaaggcaccgaatcggtgcctttttcgtgtttatcagatttcctcgccggtcgggagatacagcttatccatcacgcggacacagccgttttcaaaggtgggttccatcgtgatttcgccatcctgcttgatggtgccgagcgtcgtgccgaagcggtcaaagcaggtaacggtatgctcatccgtgcggagcgcatacacgcctgcgccgtcggtcggcagtgcgcccggacggccgttcgggcacttcacgcggaacagaaccttgttcgtgccgtccgcgtcacagcggatgtactcgtattcggtattgctgagccagtggctgtaaatgttctgaccaacctcgtcaaacgcattctgataggtctttgtcagctttttacccttgaagttgtacagcgcataataaccggtcgattctgcggcgatgtaggtatcgctgtactgattcagctgcagcgcacgcgagctggacgcaatgcgcttgcctcctgcgataatcgtgtacgaggaaccgtcccgatttacaacaacaaagcggtcacccttgccatcaccagcaagcagaatttcaacagccatcttgctgtggtcaaacgcaaaattcatgctccacagggtcttgccggtggtgtcgatggcggcaatggtcttgctgtccacgcggacaactgccttgccgtccttgaaatcggtcagtgcgtcatacgtctgcgtgctgctcgtgccatcggcatagataatgcggtccttgccataaacctcaccgccattctccggagacggacgcagccagcctgcctgctcgccatccgtgccgctaacagcgtagttttccagtgtttcgccggtcttcatgttgtgtacatcatgctgatagtccacggttttccgcagcgtgacccactcaccgaacaactcaatatcgtaaaattcgcccttggtgtccttgtaatccgtcagcaggcgattgccttttgcatcctccagatagacctgcgacacacctgcaccgacaataccataagtaatcttatatttgctgccggtgctgctcgtgctgtcgtccttgacagcatacttggtatcatacaggcgcagcatggtcgcgatggactgctcgtgcgtatagctgttattcggtgcaaaacgattgccgctgacgccgttcatcacgccgctgttgtacgcccagtacacatcgctgcgtgcccacgcctgaatgtccgcgccgtccgcgaaaacgtgcggcatacggtccttcacgctgtccttggcattcttgcgcagattgcccagacggtgcagcatgcttgccgcctgctgacgggtcagctgctgctgcggtgcaaatttgccattgccaacgccgttcaccacacccagagacgcacagagcagcacgtcctcgtccttggtatccgagaaggagaccgcggttttctcgacggattttacgttgccgctcttttcccaggtgcggtaaaccgctgccgccaatgcgcagaaatccgcacgggtgatgctctgcgtatacgcctgatcgacctgctccggcacaatgcccgcgttccgcgcggtatccaccgccgacttggcccaactgctcggcgcttccgctgccgcagctgccgttaccagcatagccgcagataaaatcgctgcaatcgttcgtttcatagaaaatcctccttttaattcagcggtcagtgatttttctttgttttggatattgcgcgcgctgttttctgatcgctgcattgtatttgacgttgggtatctgcaaaaggttcccagatttatcgggtaatgtcaaaaaaatcattgacggtgcaggtctgcagaataccgtccggcgtgtagtattcatcccgcaggacgcgctgctgctcatcataccatattttctcggttacgccatcctcgctgacgcagactgcggtgcgctcggtgtcgtcgtatgtccactcgttgtcctgcatcatttcgtaattcggatcatgcacattgttttccatgcgcagtatggaaccgcgtgcatccttcaccgtgatccatgtgccggtcagcacgccctcgaaaatcgtgctggttctggtcgtttctccggttttgggattgtattccgacactgtctgtgactgcatgttgcctgccgtgtcgcagctctgctccagatacggttcttcctcgtctccgcgataggtgtaagtctctattccgtccgcattcgctgtgcgaatgatacgcccctgctcgtcatactctgtgtaagaaaccgtctttacaccgcaggttgtggaataccacgtcattttgctgccgctgtaaaccttgcgctcgttggaactcacaccgaacggacgcttgcaattcagcgaccagatctcgcggttctgcgcatcgtagccggtgattctgagataggaccattccttctcatccggtatcacgcgcgttgtcttttgctgttcaatccgagcagcaggctgcatatacgccagaagtgtccagttttccgctgtcggacggacataccgcagtccgttcatcgataagccgccgaaaacaacgccgcagcagaccgcagtgcttgccgccagcattccggctcgtttgaagatgtcctccttcatgggcgcacctcctcagcgggtgacatcggtgtatgttgttgtaatctcacgcgaaaaaccatcctccgaaaagctatatgcattttttatccagcgtccctgttcgtcataccagtatttctcggtcgtgccctccgcctcgtccacacagatggccgtgcgcgcggcatcgtcatacgtccactgatagtcacaggttctcatctgtccgcccgcgctgaaatgcacttgctttacgatgttgccatgcgaatccagtgtgcagtactgcgaggcaagataggtaccatcgtcttcgtatatgtccatattggtgacggtactgcctgtttgcgggtcggtttcggtgatcttgcgaccggtcaacgcgccctgcgcgttgtgcgtttcctccagatacgtttcagtcgcatcgccgcggtagtaatacgtcgatatgccgccatagtcggtttccatacggataagccgtccctgttcatcatactggcaaaccgagtccgcttttccgccctgaccgaagaaataccgcgccgatgtattgccgatgtacacatcacggctgctgccgaccgatgccagcttgccgaatgtcgtgcgcgaccaaatctcgcggttctgtgcatcgtatccggtgacagtgtaggtcgggtcgccctcaccgaagtccataacgcactgctcgatgcgttccgccggttcgacccacggcagcagccaccagttatctgtcgttggcctcatgtagcgtaagccattcaccgccagcgccccgaaaacaccggctgtacaggcggcagttgccgctgtcaacattcccacacgtttgagcagatctctgttcataaacatccgcctttctctatccaattgtcctgcctgtcttatctggtttcagtatagcataaatttttccggaaggatatatctctttgcattttgaaacagaaatgtatcatgcagcggcaaaatcgtttgtctgcgcccggttggcgacggtgcgggagcacagtgtgctcccctgcggttgcgcgtgtgcagatgaatttacaggtgccgtccgcagacaccagaccaccgagttgcgcaacacgggtatcccccaggggaccttctcttgcctttcgggcaattcaccttgtgttgcgcctgcgtaaagcaaaccgcatgtgtagcagtaaagtatctggcattgagaataggtagggaaatgggcgcacactgtgcgcccctacggaagaaaaaatcctctgccgttcccctatagtctcagttctgcaaatttcgccgtgctatctcaaaaggaaacgggattcaaaagggtggaaaccttggtgtccatccttttgcccaccgccgtgggtacggcgaactcctgcgctccgcagagcgcaactctccgcttgattaaaacgcaaaaaaatcccgcagagaaaacctctgcgggatttattatgctatttcagtaagcgttttgcgcgatcttacgcctcgggagcgtacagatcctgcaggcgcttcaggtgagcgtaacgcttggtagactctacctcggaacgctcgaacaggccctctgcacgatccgggaatgcacgggtcagtgcggagtaacgagcctcgcccatcatgaacttgcggtaatcctcggtcttgggctccttggactccagaatgaacgggttcttgccctcgtcagccagctgcgggttgaagcggaacaggttccagtaaccgcagtcaacagccttcttcatctcagcctggcagttggtcatgccgcccttgatggagtgcatctcacacggagcatagccgattaccagcgacgggcccggataagcctcagcctcagcgatggccttcagggtctgagccgggttagcgcccatagctacctgtgcaacgtaaacgtagccgtagctcatagcgatctcagcaaggctcttcttcttggtggtcttaccggaagctgcgaactgtgcaacagcgccgatgttggtagccttggaagcctgtccgccggtgttggagtaaacctcggtatcgaataccataacgtttacgtccttgccggatgccagaacgtgatccagaccgccaaagccgatatcgtatgcccagccgtcgccgccgaagatccaaacggacttcttagcgaggtattccttatgagccagaacatccttgcagtccgggcaacctgctgctgcgcccttttcgagctctgcaaccagtgcctttgccggctcagcgttagcagcgccgttgtccttggtatccatgaagctgttaacagcgttcttgaagctgtcggtagcgttctcagagccagccataacttccagcttggagatcaggcgctcacggagagcttcctgaccatagtacatgccaaggccgtgctctgcgttatcctcgaacagggagttagcccatgccggaccgtggccgtttgcatcaacggtgtacggggaggtagcagccgggccgccccaaatggacgaacagccagtagcgttggagatgtacatgcggtcgccgcaaacctgagtgatcaggcgggcgtaagaggtctctgcacagcctgcgcaggaaccggagaactcaagcagcggcttcttgaactgcgaatcctttacggagttcgtggagatcatgtcggccttctcggaaacctttgctacgcagtaatcgaatgcatcctgctgagcagcttcctctgcctgcggtaccatcttgagggacttggtcgggcagacgccgatacatacgccgcagcccatgcagtccagcggagatacagccatggtgtacttgtaaacgcccttgcccttgcctgccttgatgtcaaccagcttggtggaagccggtgcagcagcagcctcttcttcggtcagtgcaaacggacgaatggtagcgtgcgggcagacgtaagcacactggttacactgaacacaggtagcctcgttccactgcggaacggtaactgctacgccgcgcttctcgtaagcagctgcgccgtgctcgaaggagccgtcaacatgctcgcctgcgaatgcggataccggcagggagtcgccgtccatgcggccgatcggctccataacgtccttgaccatcttgacaacttccggacggccctgcagctcgcgggtatcagcctcgtcctgtgcgtcagcccagtcagccggtacgtcgatcttctggtatgcggtagcgccgatgtcgatagccttgtggttcatatcaacgatgtcctggcccttcttcaggtaggacttggtagcagcgtccttcatgaactggatagcctgctcgctcggcattaccttagccagtgcgaagaatgcagactgcagaatggtgttggtgcgcttgcccatgccgatctcgatagcgaggtcgattgcgttgatggtgtaaagctgaatgtcgttcttagcaatgtagcgcttctcggaagctgccagatgcttgctcagctcttccggagaccactggcagttgatgaggaatacgccgcccggcttaacgtcacgcacgatcgggaagtgcttggtgatgtaggacgggttgtggcatgctacgaagtcagccttgttgatgtagtaaggagaacggatcggcttgtcgccaaaacgcagatgcgaaacggttacgccgccggtcttcttggagtcgtactggaagtaagcctgtacgaacttgtcggtgtggtcgccgatgatcttgatggagttcttgtttgcaccaacggtaccgtcgccgccgagaccccagaacttgcactcggtcgtgccttctgctgcggtgttcggtgccggcttctcctcgagggagaggtaggtaacgtcgtcgttgatgcccagggtgaacatcttcttcggctctgccttagccagctcctcgtatacagcgaatacggaggacgggggcgtatccttagaacccagaccgtaacggccgccggttactaccttatcggtgatgcctgcatcagccagagcggtaacaacgtccatgtaaagcggctcgccctgggagcccggctccttggtgcggtcgaggactgcgatcttcttagcggtctccgggatagctgcgatcagcttgtcagcacggaacggacggtacagacgaaccttaaccaggccgaccttctcgccgtgtgcgttcaggtaatcgataacttcctctgcaacgtcgcagatggagcccatagcgatgataacgcggtcagcatcagcagcgccgtagtagttgaacagctggtagttggtgccgagcttggcatttaccttgcccatgtactcctcaacgatgcccggaacagcttcgtagtacttgttggcagcctcgcggtgctggaagaatacgtcgccgttctcgtgagagccgcgcatcatagcgtgctccgggttcagtgcgcgcttgcggaatgcttcaacagcatccatgtcgcacatttccttcagatcctcgtaatcccaaacctggatcttctggatctcgtgggaggtacggaagccgtcgaagaagttgatgaacggaacacgggacttgatggtagccagatgtgctactgcagaaaggtccataacctcctgcgggttggtctcagccagcatagcgaaaccggtctggcggcaagccataacatcggaatggtcaccgaagatgttcagtgcatgagatgcaacggtacgagcggaaacgtggaatacacacggaagcagctcgcctgcgatcttgtacatattcgggatcatcagcagaagaccctgagaagcagtgtaggtggtagtcagtgcacctgctgccagagagccgtgtacggtacccgccgcacctgcctcggactgcatttcgattaccttaacggtagtaccgaaaatgttcttctgacctgcggcagcccactggtcaacgctgtctgccatggggctggacggggtgatcggatagatacccgcaacttcggtaaacgcgtacgatacgtgcgcggccgcagtgttgccgtccatggacttcatctttcttgccatgttgatgtcctcctataaaaaattataattctcaatcggaattaaaagccctcgttttggtgtattttaacctaaactaagccttacctgccccttcattgtagcactcacgcacaaagttgtaaacagtaaatgtactattttccgcactatttttcaaattttgataagatatttcatattatgaaacgcatgcaaactttttatcatggagtttctgtgttttttccgtgttttttattgcgtaatctgatgacacatagtatagtattagatgtatagttatatggttatgccataagtatcggagggatcggcatggtatctcgcgtattctccgcaggactgagcggcattgacggctacattgtcaccgtcgagtgcttcctctccggcggtcttccccggctggatgtcgttggtctgccgaccggcgcggtatccgaagccggagagcgcgtccgtgccgccgcaaaggcctgcgcctttgactggcccgtgtcccgactgaccgtcaacctcgcacctgccgacaccaaaaaggcaggaacagcatacgatctgcctattctgctttccattctggcggcagcgggcgagattgatgcaccgcccgacaacgctctcttcttcggcgagctttccctcaccggagagctgcggcctgtctgcggtgcgctttccatggcgcttgccgcgcgtgatgccggtttcaaaaccgtgttcgttcccgcgatgaatgccgccgaagcatcctatgcttccggtgtgacggtgtttccgatccgtacattaaatgagctgctcggacatttgaacggcagaaagccgctcacgccgtgcgctcctccgcccagacccgaaccgcaggacgatgcgctggattttgcgcatgtgctcggtcagcacgcggtcaaacgcgcgctcgagatcgcggctgcaggcggacacaacgtgcttctttccggaccgcccggttcgggcaagagcatggctgcaaagcgcttttccaccatcctgccgccgctgtccgacagcgaacggctggaggttatccgtgtctggtccgccatcggcagaggacaggaggcagtcgagcgtgccgaacggccgttccgtgcaccgcaccataattcctcggccaacgcgatggctggcggttcgggtgccgcagggcggctgcccgtccccggcgagatcacgctcgcacaccgcggtgtgctgtttctggatgaatttccggaattccgccgcgatgtgctcgaaaccctgcgccagccgcttgaggacggcagagttaccatctcgcgtgtcgccggtcaggtgacgtatccggcacggtttcagctcattgccgcgatgaatccctgcaaatgcggctggtacggcacggaacgctgcacctgcaccaaggctgccgttcagcagtatctgcaccgtctgtccggtccgctgctcgaccgaatcgacctgcaggttgctgtgcagccggttgaatacgccgcgcttgccgcacgaggccaggccagtgaggaacactccgccgacattcgtgcccgcgtgctcgccgcgcgcgagcggcagtatgcccgacagggcgccgacgtatgcaacgccgccattccgccgccgcagcttgccgagcactgcccgctgagcgcggatgcgtctcgtatgtttgcggccgcatttcagcggttggggctgaccgcccgtgcgcatgaccgcgtactgcgcgttgcccgcacgatcgctgatctggcagacagcagtgtcatcgaggctgagcatctcgccgaggctctgcagtaccgttcactcgacagagccgcgggttcttgacagcttgtggaaaagtctgtggactatgtgtataaatttacaattactgtaatttcgtctaaattcgactatttattgacatactggtttgttttatcggcaaaccaacaaccagtcaggaggaaaattcaatgtctcatcctatcgctcgccgtgccggtatgcttgcgctgactgccgcaatgctcatgccgagcgcgggagcattatccgatgtgtccagctgggcgcaggaaggcgttgccgctgcgcagaatgccggtctggcaccttcgtccctgtccaacagtgccgcttccggctctatcacccgcgcagagttctgtgccgttgcgctgaacgcctacaaggctgtcagcggcaaggctgtctatgtttcgggcaaaaaaccgttcgaggactgctcggaccccaatgtcaccgcagcttacctgctcggcattgcaaaaggccgcaccaacggcaactttgatccggatgccaagatcagccgcgaggaaatgtgcaccatgttcaacaacatcctcgccgctgccgatatcgaagcaaccgagatcgccggtgatgcctgcatcgaggattaccccgatgtaagcatgatcagcgattacgcaatgcagccggtcgttaccatggtcgatcattcggtcatcaacggcatcaccgataccagcacggacaccaccattctggccccgtccggcaccaccacccgtgagcaggcgctgatcatggcaaaccgcttctgcactgccttcaagccggataagacgccgattgcagcggttgacggctccgctaacctgccgaccaccgccggttcttccgcctctgccgcaaccactatcgccggtctgccgcagaccgaggctgagaagatgacctacgtttacggcgcaggcaacggcaagtaccagtccgcagctgaggctgaggctcacatggtcgagatcgtggttccggtatggcatctgcagtccgacggcaccaaggtggcctccaaggcttacctgcaggtaaacgcttcgctggcttccatctatcaggccatctttgaggagatcttcaacggctccgagaagttcccgatctatgatgtaggctgctactcgtggcgtactggcgagcactcgcagggcaccgcagttgatatcaacccggacgagaacatggaagctaccatcaactcggacggttctctgtctccgacctgcggcacccactggacgccgtatattgatccgtactccatccccgagggcggcgatgtttacaatgccttcaccaagtacggcttcacctggggcggcaacggctggcacagcaagcgcgactacatgcacttcagctacttcggccgctaagcactacatacgaaatggcaaaagaagggacggcttatcgttagccgccccttatcttttgtgaaatttgtgtaactttacaggaatttaatttgcaattttagaataacatgctataataatatatagagtaaattagcaaggaggcatgacatcatgagaagactctctattccgcagaagcccgaccgtccggacatcgatgatctgatctttggtgatgaccataagacgcagagtgaaaagtaaccgcactttttgatcggttccacgcagggcttgcagagaaacagcagccgcgtggtttttttatacctgtttttgaaaggaaacatataaaaatggaatcatccagtcccgcgtcacggacaaaaatgtaacacccgaagcatttttaatgcctcgggtgttttttctctctgcatcgattgacctggggacacgaacctcgtaagcgtattcgcccctaacgggcagaaggttttcgctgaacctcagcagggatttgcgctgacgccgcgcgggcacacaaaagggtagacaacctgcggttttccaccctcttatgaatctccccttttcccttagatggtctggcgcagattgccgacatgtgaccgctgcgaaataaggagaacggcagtcgggttaccgttgcgtgtttttctccgccttgtcgcagttcacagataccgtactgctacacaggcggttaaatcaacgctgggtgcggcataacaatgccgcacaactcgtttatctggatactacggacagcacctgcgaatttcacctatccgtcaactcctcactcctaactcctatcttgcacaatctcctcgctctcgactcttcactctaaaaatcaattttaattacattaaataggtaaaataaaaccccaccctgccgatgcagtccaattagtaacctgcacgactcatgcaggtgggtcctctgtttgatacctctgcgcttccaacttccgtgtatacccgggaggcctgctgctcagtatcaaaactttccgaagtcccgtactaaaaatgtgggttaaaaaaggactgctgtcgaacagggcaggatcttaccgaaataaaatgctttgcttccgataacgaagctgcgctgtttactcttattttatgctctcggccggagaattactcctcctctgcctcggcgcgttccataacgatgtcgaacactgcatctgcgatctcgtcatcctcgactgcctcgagcagctcttcgccgttctcctcaacgatccgcatgataacgacctctgcatcctcctcgatggagatttctgcagggataaacgccagataggtcacgccattatattccacggtgtcgatatgctcaaactcgacctcgttgccgtcctcgtcgatcagggttacaaaatcattgccgtattcctcgctcatgggtccggcacctccttaaattcatagtaaaggggagaaatcaggtgtttcctgtcccttgtattaagcataacaaattatgacgtatttgtaaagccttatgttgtgcattcagcactacactttacacgatcatagtatgtctgttactgtaataatcataccagttaaaaaacgtgaaataaagccttgactttgcaaattaattctggtatagtatttaaggtaacaaggaagaaggcaggtcctcacccgcagcgaagcaaacgggtcaataaagcacagaagccgctttgcgcgctctgcgattttattctggaggacggtcattcgatcagtcctttttctttttgtcttaaaccgatttcgtttggaggtgcttaccaatcagcagcatggaacatcaaatcaatgaagagatccgcgacaaggaagttcgtctgatcggtgacgacggcgaacagctcggcattctgcctattcagcaggcacaggatattgccgtagaaaagggcatggatctggtcaaaatcgcgccgcaggctaagccgcctgtctgcaagatcatggattacggtaaattccgcttcgagcaggcaaagcgcgagaaggaagcgcgaaagaatcagcgtgtcgtggagatcaaagagattcgcctgacgcctaatatcgacatcggcgacctgaacaccaaggtaaagaacgcttgccgcttcctgcaggacggcaacaaggtcaaggtttcggttcgcttccgtggccgcgaggtcacgcacgcgtcgcttggtcaggatctgctccatcgcttcgcggagctgtgctcggagtgcagcacggtagaaaagcagcccaagctcgaaggccgccagatgctgatgtttctggcgcccgcaaaggacaagtaaaaccaacgcgcagatatagcgcaaattcagagaggagcaaaaccttatgcctaagatcaaaacgcacagcggtgcaaaaaagagattttccgttaccaagaacggtaagttcaagcgcggtcacgttggcaagcgccacctgctcaacggccatggcaagaccactaagctgaagcgccacctccgcaaggaaggcttcgcagattctaccaacgtagcacagctgaagcgtctgctgccgtacaagtaagttagaaaacaacatctttcatataggaggcaaacacaatggcaagagttaagggcgcaatgatgacccgtaaaagaagaaagaagatcctgaagcgtgctaagggttactggggttccaagtctacccactaccgtgtagccaaccaggccgtaatgaagagcctgaagtacgcttacatcggccgtaagcacaagaagcgtgacttccgtcgtctgtggatcacccgcatctctgcagcttgcaagacctgcgatatcaactacagccgtttcatgaacggtctgaagaaggctggtatcgacctgaaccgcaagatgctggctgacctggctgtaaacgaccaggctgcattcgctgcactggctgagaaggctaaggctgcactttaattgcataacaaaaacgagtctgtgaaaacaggctcgtttttttgcattcagcgttccgatcgggacgctgttttcatattccgcgtttctccgccctatactgtgatggtaaggagtgtgatgaaatgggtccatccatttacttaggcgtacagggctacggctgcatccgtgccgaggataaagaccggtttgcgcatcggtttcggcaggacgacagcgtgtgctgctatgccgtgtgcaataaaggccgctacgccatccagaaccgcctgcaggaaggtcaggcgtatcatttgaccatccggcagggaacggtgacacaggccgttctcagccgtccggatgcacaaggcgtaatcaatgccgtcagcggcaattccatcacggtagacggcatgcaccttccctgccgcgctgtgtttgaaatccgcacacgagccggcggcgctgtcgttctgccttgctttctcaccggccggattgtcggcagttatgcacaggtattcggccgtgttgcgtatatccggcctgctccgcagatgtatcatccgccggttcacggtgttcccggtcagcgcaccctgcaaaacctgctccgaaccgccttgatgcctgtcggcatcgtcctgtacgtctacggcggcggctggaaccggcaggataccggctccggcaacaccgctatgcacattggtctgccgcaaagctggattgacttcttcgaccgtcagaacgcctgctatgcctaccgcaacgacagcaatcccgcgcacagctactacccgaccggcggctggaaccagtacggctatgctggtctggattgctcgggctacctcggctggacgctgtacaataccctgcataccgagagtgcgtctgtctccgactgtgacggctatgtcacgcccgccgccgagtttgcccatacgcttgcccaaagagcctggggtactctttcccgtcaggactgcggcaacggcctgcaggagccgtcctcgttccgtcccggcgatatcttcagcatggacggccatgtgtggctgtgcatcggtccctgccgagacggcagcattgtcatcgcgcactctacgccctcgcccagtaaaaccgattgtaaaggcggcggcgtgcagctcagcgcgctcaatcccgcgagtgatgcagataaggattgtcaggcttatcggcttgcagaacgctttatgcagcggtattcgagatggagcgcaaggtatcaggcgcagctgctgccctattcggtttatgggaagctgtctgagaatccgcatgcaggattgtttcggtggaatgattttctatcggataaagaaggtgttcgaggacagttcgcggaggagattctgcaaattgagaattgaaaatggagaatggagaattacgcagcggtaaagcgttgtgcgggcggccaacggccgcccctgcggttacgcaaggtgcagatgggttacaagcggtgcgccgaggtcgcaccctacggtatcatccgttatcaaacaaaacccgcagatgccgtccatgaccaccgagcaaacgagttgcgcgacactgttatcccccaggggaccctctcttgcccttcgggcaattcaccttgtgtcgtgcctgcgtagagcagccgatatgtgtagcggtacggaatccggcactgcgcagagctaaagaaatgggagcacactgtgctcccctgcggtaataaaaatcctctgctgttcccctttttcgaagcggtcgccggtctctgatctgcgccagactaacaaacaaaaggaagtgggagttaagagggtagtactcatttaatccgcgcacggcgcgggaacaaggtttagtggcctacgggcaaaccttggtgtctaccctcttgccccgccgcagggtgcggcgacttcccgccaaagattggcgcccattcctcaatcttcagcgaacagaaaaagcaaaaatccacttgctttcgcaagtggactaactggagcggctgacgaggctcgaactcgctacctccaccttggcaaggtggcgctctaccagatgagctacagccgcatatgtgattttgagaagaaaaggtggagcggctgacgaggctcgaactcgctacctccaccttggcaaggtggcgctctaccagatgagctacagccgcatattcctttcatctcgcttttggcttaccgcctcaaagcaagatttattatatcaggtgatgtgtcccctgtcaacacttttctttcttttttcgcaaatttttccgaaatacagaaaaccgacggcacacaccgtcggttttctctttctcttttccttttcagcttctcagtgcacccagacctcttcgtgctcgccgcggcgcggacgattgagcagatgcttgatcgcctcctgtgcaggcatgccgccgtacagcacggcatacatcgcttcggtgatcggcatggacacgccctgctgctgtgcaaggtgatagcccgcctcggtcgcgtaatagccctcgaccgttgcgccaacctccttcatcgcctcctgcgccgttgcgcccttgccgatcaggataccggcacggcggttgcgcgagtgcatagagcagcaggttacgatcagatcgcccacaccggacaggcccgcaaatgtctcctgcttggcgcccagcttgacgcccagacgcgcaatttcggtcagaccacgggtcatgaacgccgccttggagttgtcgcccagacccagaccatccgaaataccggcgccgagtgcgataatgttcttgaacgcaccgcctagctcacagccgatgatatcagacgaggtgtacacgcggaagttggtgtcgttcatgaacgccgcctgcgtcagctcagccgccgcacggctctccgaagcagctacgatagccgtcggaatgccgcgcgcaacctcctcggcgtgcgtcggaccggtcagtgcaacgaccggattgctgccgttcatcgcgttcgagatggtctcggagaaccggcagtatccgtgcttggagtccagacccttgccgacgttgacgataaccgtatgcggcggcacgatcttcgccagccgttctgccgtgctcgctaccgcgaaggacggcaccgccagcacgaccagatccgctttggcagcgccggacatgtcggtcgtaatctcaataccctccggaatgacaacacccggcagcagcttctcgttgcagcgctcgcggtgcagcaggtcacactcctcctgcagataggtccacgaggttacttcatgtccgttctggtgcagcagcatcgccagtgcgatgccccagccaccggtacccagtacaaaaaccttcatgttacttctcctctccgtcaggcgatgcttcgatcgtctttttgctcttaaaagagaatttattttccgtgccgtgcaggatgcgtccgatattcgagcggtgcatgaaaacgactgccgccgccatgccgaacgccattgccgtcagcaccggatcgcgatagaacagccatgtcgtgatcggaaagctgaccgcgccgaggatcgaaccgagcgagatccactttgtcagcacgaccgacagaatgaacagcgcgaatgcaatggcgaacacgcgccagtcaaaaaacgcgagcataaccgcgccgaccagcacacccttaccgcccttaaagccgaaatacagcgggaacatgtggccgaggataacaaaaatacccgctgtcagcttgccgaccggaccgccgagcgcccagccgaccgaaaccgctgcggcacccttggcaatgtcaccaagcagaacgaacagcgtctttttcgcacccatcgtgcggtacgcgttcgtcaggccggcgtttccgctgccgtagttgcggatatccttgccaagcgtcaccttgctgacaatgatcgcaaagctgagcgagccgagcagatacgcgcacacggcaatgatcgcaaaatgcgtaagtgtcatgttgccctctccttactgcgacttgtcgctgcgctcgcggatgaccatgcgtaccggcgtaccggtcagaccgaacacctcacggatctggttttccagataacgctgataggagaaatggaacagacgcgcgtcattgcagaagcagacgaatgtcggcgggcaggtagaggcctgcgtcatatagaagatacgcagacggcggcccttgtccgtaggcggctgcacacgtgcggttgcctctgcgagaatggcgttgagtcggccggtcggaatgcgcatatggttctgctcatatacctcatggatgagcgagaacagcttgtccacgcgctgaccggtctgcgcggaaatgaacagcaccggtgcgtacggcatgtatgccagaccctcacggacacgcagcgtgtactccttcatggtggagccgtccttctcaaccagatcccacttgtttaccacgatgatgcacgccttaccggcgttgtgcgcctctccggccaccttggtgtcctgctcggtaacaccttcggtcgcgtcaatcatgataacgcatacatcggcgcgctctaccgccagcagcgaacgcataaccgagaatttctcgatcttctcgtccaccttgctcttcttacggataccggcggtgtcgatgaacgtaaacttgccgtgcgcgttgtccacatcggcatcaacactgtcgcgggtcgtaccggcgatgttggagacaataacacgctcctcaccgagcacgcggttgagcagactggacttgccgacgttcggcttgccgatgagagccacgcgaatgcggtccgcgtcctcctcttcctcgtctgccggcgggaagtattcgtaagccgcatccagcagctcaccgacaccgtagccgtgcagtgcggaaatgccgtacggctcgcccagaccgaggttgtagaactcataaaactccgccggaggatcacccggcttgtcgcacttgttgacagccagcacgagcggcttgcccgagcgcagcagcatggacgcaacgtcctgatcggcggcagtaatgccggtgcgcagatcggtgatcaggataatgacatccgcatgcgagatcgcagtctctgcctgaaagcgcatgaactgcagaatctcgttatcgttcgacggctcaatgccgccggtgtcaatgacggtgaaatcacgaccgcgccagtcgctgtcagcgtacaggcggtcgcgggtaacgcccggcgtatcctcaacgatggaaagccgcttgcccgccaagcggttgaacagctgcgacttgccgacgttcggacggccgacgatcgcaacaataggctttgccataaatttcccctcctttaaggtcagtttaagacatttgcaaacaaattgcaagcaagaaattcgttaaaaccgcgcgtcagcgcgcattcaatagaatttccgcagaaaattcacaaaaagccgcagcatgtatgtggcttttgatacaagaaagcaaatcagtatgcccgcaaggacgcgctgatttgcgcccggaacatatccgagccgtgctcggtacgtccctctcgatgcaaaggcgagccttttcatcgaaacctgaaaaaaaatggagaaagctatccggccttctccatttttcctgttctgttttaaggcttacgcttccttaacggacttaacctcacgaccgttgtaatagccgcaggccttgcacattctgtgcgccagcttcatctcgccgcacttcgggcacttagtcatgccgggcagagagagcttccagtgggagttacgacgcttgtcgcggcgtgccttagaaattttacccttaggtactgccatgttggatacacctcctactctatcgtcttatttttcaatacgaactcattcgcccttgtcggaatcgagcagggcgcgcagcgcggcaaatcgcggatcgatctgctttttatcgcaatcgcagtcggtcacattgcggtcggcgccgcagtgcggacagaggcctttgcagtcctctttgcacagataggtcatctgtacctgcaggatcaatgccggcaccaatacgtccgcaggatccacgctgtcgctggtcagcacaaaaagatcgtcctcttcctccgcctcggggtcatccgagagcatcatatcggcctcggctgagagcggaatctcgagcggtttcaggcagcgtgcacattcggtggagtagatcgtttcgatcgaacccgccagtctcacaacaccgctttcattggaaaccacgcctttgatatggacagggctttgaaacggcttcgcgccatagagcttttcgtccgtcaggtcgatcgtttcatcgaacggaatcgacgcatgtgcagacgtgttcagcttttttaagtcaatcttcatgtcaacctcacatggtactaagatagtatactacaaacaatcggtctttgtcaaccaaaaaatctacaaaacacggtatttttccgaactgtccgcccgcacttttcttttttcggaaaatgcggtatactggtttcacccaaacgggcaaatcaacggaaaaggataccctgccttgagagaatattatatcacaaaaaacgacagcggacaacgtctgaataaatttttagagaaagctgtgccgcttttatccggcggcatgatgcacaaatacctgcgattaaagcgcatcaaggtcaataacaagcgcactgaagctgcctacaagctcgccgagggcgattccgtgcagctttacctcaatgacgaatattttgacgcgcccaaggaggaagaagccttccgccgcatcaaaacaccgcgcgtgcgcgtcgtgtacgaggacgagcacatcctgctggcggataaggcgccgggcatggtcgttcacgcagatgagcacggcgacacggatacgctcatcgcacacattcaggcgtacctgtttcagtccggtgcgtggaatccggatgatgccgcgtcatttgcaccagccctgtgcaaccgtatcgaccgcaacaccggcggcatcgtcatcgcggcaaagaccgctgaagcgctgcgcatattaaatgataagatcaaggaccgcgagatggaaaagcggtatctatgcatcgtgcacggcagacccaagccgcccgagggactgatcgagaattatctccgccgtgatgaaaagcgcaagcaggtcacactgcacaggacccgcgtgccgggtgccaagaccgcacgcacgcgctaccgcacgctcacgtcgcacggcagactgtcgctcgtggagtgtgaactgctgaccggccgtacgcaccagatccgcgcacatatggcgtccatcggctgcccgctgctcggtgacggcaaatacggcacgaacgaactcaaccgtccctacggcgagaccggtcaggcgctctatgcctattccctcaccttccgattcgcgcaggacgcgggagccttgcagtacctcaacgggaaaacctttaaggttaaagatattccgttcgtgaagaagtattttccgaatttcaagccgtgagtaatggaaaacggagaatgaacacaacggtttcattccgcaaaaagaaaacgctgagccaccgctcagcgttttcctttatgcgatttagttatcgtcctgcagggcatcaaagccttctgcgccggtacgaacctttacgacgttctccacatcgtaaacgaagatcttgccgtcaccgatatgaccagtatacagaaccttcttgaccgtttcaacaacggtttcaaccggaaccttggatacaacaacctccatcttcagcttgggcagcagagttacgtcaacctcagcgccacggtaatactcgggagcgcccttctgtacgccgcagccgactacgttggtcacagtcatgccggatacgccgatgcttgccagtgcttccttgagcacctcaaacttggactgctttgcgataataacgatcttgctgagcttatgctcgtgcgaagcgccctcggtcgtcatcttggtcaccggaactgccttttcgactgctaccggaatggtgtccttgatctttgcagcattttcgccagccttggtgcccagaacagtaggaacgaccggcataaaatctgcgtatgcggaggacaggccatgctcaggcttatccagacccatgatctcctcagcctcgcttacgcgcaggccgatggtgtgcttgataacattgaatacgatggtcatggtgatcgcaacccaagcgatgactgcgactacgccgagaacctgaatgccgaagaagtggaagccgccgccgtagaatacgccgagaggctcaacctcagtgccattatagtaagcgaacaggccggtaaggatggtgcccagtgcgccgttgatgcagtgcacgccgacagcgccgaccggatcatcgaccttgagcttctgatcgacaaattcgatgccgaatacaacggcaaagcctgcgcagataccgatgataaccgaaccgaacggagtaaccacatcgcagcctgcggtgatggctaccagacctgccagagagccgttcagcgtcatagaaacgtccggcttcttgtagcggatccaggtgatgcacataacggtaacggttgcaacagcagctgccatgttggtggttacaaatacacgggatgcaacctcagcaccgccgcccgacagtgcaacggtagagccgccgttgaagccgaaccagcagaaccacaggataaagcagccgagagcgccgagcgtcagggagtggcccgggattgcacgagccttgccgtccttggtgtacttgccgatacggggaccgaggatggctgcaccgatcagagcggcaacgccgccgaccatatgtaccgccgtggagcctgcgaaatcatggaagccaagctctgcgagccagccgccgccccagatccagtgaccggaaaccgggtaaatgaccgcagaaataatcatcgagtaaatgcagtatgcagagaacttggtgcgctctgccatcgaaccggaaacgatggtcgcggcagttgcacagaatacggtctggaagatcagggtcgtccagtcgtagccctcaccgacaacgccgtcagcgaagaaatcaaagccgccgaagaacgggcttgccgcgccgaacatgatgccgaagccgaggatccagaagatcggcgtgccgagcgagaagtccatcaggttcttcataatgatgttgccggcattcttggctctggtgaagccggtctcaaccattgcgaagccggcctgcatgaagaatactagcgccgccgcaacgagcgtccagcctacgtccatcgacgtagcaagttccatgatatccatttttaataacccccttgaaatagaaatggcgtgtacctcccctttcttctaaaagaaagggaaaatacacgccattgtgtaaatattaacgaatgtaagttacgttcttaaacgtagaacagaatgtcggagtaggtcgggaacggccagaacttcttgcctaccagaccctccagcttgtcggccggtgcacggacttcgtccatcgcggagatgacaacatcgtgatagtaatgtgctgccttttcgttgtcgtcggtcggaacggctgcaatagcctcgtcgagcgctgcgctcttggtgtacagctcctcggtcagctcggaaaccatgcccagcagacctgcctccatgccgccggtaacgcctgctgccttcttggcattgacggtgcctgccagctcgttttcaaatgcgatgcacgccggagtgatctcctcgcgtaccatatcgctcatggtcatagcctcgatgtgcaggatcttgttgtactcctcaagctgggtctccatacgggaatggatctccgcaggggtgtaaacattgtgctttgcgaacaggtcgaggttcttctggtcaacgtaatgcgggaatgcatctgccgcgctcttgaagttgagcaggccgcgcttctccgcctcaacaacccaggactcgtcgtagccgttgccgttgaagatgatgcgcttgtgcgccttgatctcgcgcttaatgagtgcgtatacagcagcctcgaagtcctcagcgccctctagctcgtcagcgaactggcggagctcctcggcaactgcggtattcagcataacgtttgcacacgcgatgttgacggccgaacccagcgaacggaactcgaacttgttgccggtgaaagcaaacggagaagtacggttgcggtcggtggtgtccttcgggatcggcggaagaacagcagcgcccagatccatcttggtcttgtaaacgtcggtgtactccgcaccggactcgatggaatcaaggatcgactgcagctcatcgccgatgaacatggagatgatagccggaggcgcctcgttcgcgcccagacggtgatcgttgcctgcggatgcaacagagatgcggagcagatcctgatactcgtcaacagccttgataacagcggtcaggaacaggatgaactgggtgttctcgctcgggttcttgcccggctcgagcaggttctcgccccgatcggtggaaatggaccagttgttgtgcttgccggagccgtttacgccctcgaacggcttctcatgcagcaggcaggtgaagccatgcttctgcgcgacggtacgcatgacctccatggtcagctggttgtggtcggtcgcgatgttggtggtggtgaacaccggcgccatctcgtgctggcacggtgcgacctcgttgtgcttggtcttggagaggatgcccagcttccacagctcctcgtcgagctcctgcatgaaagcagctacacgcggacggagtgcgccgaagtagtgatcatccatttcctgacccttcggcggcattgcaccgaacagggtgcggccggtaaagatcaggtccttgcgctttgcgtagtcctcgcggtcgatcaggaaatattcctgctccgggcctacggtggtggttacacgcttaacatccttgccgaacagcttaaggatgcggcacgcctgcgtgctgatggcgtccatcgagcgcagcagcggcgttttcttatcgaggatctgaccggtgtaggagcagaatgcggtcggaatgtaaagggaaccatcctttacaaatgcgtagctggtcgggtcccatgcggtgtagccgcgtgcctcgaaggttgcgcgcagaccgccggacgggaaggacgatgcgtccggttcgcccttgatcagctccttgccggagaactccatcatcacatggccgtcatcggtcggcgtgatgaacgagtcgtgcttctcggcggtgatgccggtcatcggctggaaccagtgcgtgtaatgggttgcacccttgctgatcgcccagtccttcattgccgttgcaacaacagcagcaacatcggcgtcgatcgcggtgccctcgcgcatggtcttcttcagcttcttgtaaacgtccttgggaagacgttctttcatcacagtgtcgttaaacaccatgctgccgaacagctcgggaacattcgtaatgctcatgaatggttcgctccttacatatgttaattttaatagcaaacaaactgaataaaacaaatcaggcgctgcgggtcgtgtgcccacagcgcctttgctgtttacactttgcattatagccgtcctgccttgctttgtcaagggagattatggtgtttttttcatttccggaagatttgctacaacatacttaattttcgcttgtccgcactgtcacttcctgtgcaaaatgtgaaaattcacttttttatgttctttgcgcttgacgattcccggttccctgctataaaatatgaagcgaacaaaggtgttcgccatagctgaggatttaaggcttttgatcctctgctgcggcgagcacctttttattttgttaagcagccggtacatatcgccttccatctgaaagcacccgccgaagcctgcttctctgaatccgtaatttcagcgcaatatataaggaggaagcaccatgttacaaaaagaagggcaagtccgcatccccgcaggctgcgcgatctccggtatcttccacaaggacggcacccgtgagaacggcacccgcattatcgactccatccgcaccatgcacgatcgttccaacggcctgggcggcggcttcgccggctacggcatctaccctgaatacgccgattactatgcgttccatgtattctatgatacgcaggcggctaaggaagagtgcgagcgcgagattgagcgtcactttgacattgtaaacctgtccaagatcccgacccgacgtcatccgcgcatcacggatgccccgatgatctggcgctacttcgttacgcccctgccgaccaagctggcagccagccagctcgaggagtgtgagttcacctcccgctttgtcatccgcatcaatcacacgctgaacggcgcttacatcttctcctccggcaagaacatgggcgttttcaaggcaaacggcttccccgaggacgtcggcgagtactacatgctggaaaactacgaggcctactcctggacctgccacggccgttatccgaccaacacaccgggctggtggggcggcgcgcacccgtttgcactgctcgacaccacggtcgttcacaacggcgagatttcctcttatgatgcaaaccgccgcttcattgagatgttcggctactcctgcgacctgctgaccgacaccgaggtcatcacctacattattgattaccttggccgcaagctgggcctgacgtacagcgagattgcaaatgtcattgcggctccgttctggtccaccattgaaaagcaggagccgaaggagcgcgagcgtctcacctatctgcgcaatgccttcgcttccctgatggtcaccggtccgttctccattctggtcggctacaccggcggcctgatggcgctcaacgaccgactcaagctgcgcagcatggttgtcggcgaaaaggacgacaccgtatacatcgcctccgaggaatgcgcgatccgcgtcatccagcctgagctggataagctgtgggcgcccaagggcggcgagccggtcatcgttaatctgaagaacggagggaaccagtaatggctatcgattttttatatccgcagtatgaggtcgtccgcaacaacgaccgctgcatcaactgccgcgcctgcgagcgtcagtgcgcgaacgaagtacacttttgggacgccgacaacaaccgcatgcaggcggacgagtccaagtgcgtagcctgccaccgctgcgtggcgctgtgcccgacccgtgcccttaaaatcgtaaagaccgaccacacgttccgtgagaacgccaactggaccggcaaggcgatctccgaggtttaccgtcaggcaggctcgggcggcgtgctgctgtcctcgatgggcaacccggacccgcaccccatctactgggataaaattctcatcaacgcttcgcaggttaccaatccgtccatcgacccgctgcgcgagccgatggagaccaagaccttcctcggcaaaaagccgggcaagattgagcgtgacgagaacggcaatctggttcccaatctggcgccgcagctggagctcaacctgccgatcatgttctccgcaatgagctacggctcgatctcctacaacgcacatgccgcactcgcacgcgctgcaagcgcgctcggcacctattataataccggtgagggtggtctgcatcaggacttctaccagtacggcccgcacaccatcgtgcaggttgcatccggccgtttcggcgtacataaggattacctcgaagccggtgctgccatcgagatcaagatgggtcagggcgcaaagccgggtatcggcggccatttgcccggactcaaggtcggcccggatatctccaagacccgtatgatcccggagggcacggacgcgatctctccggcgccgcatcatgatatctactccatcgaggacctgcgtcagctggtttactcgctgaaggaggctaccgaatataagaagccggttatggtcaagattgcagccgtaaataatgtagcagcagtcgcttccggcgtggcccgctcgggtgcagacatcatctgtatcgacggctaccgcggcggcaccggcgcggctccgacccgcatccgcgacaacgtcggcatcccgatcgagctggcgctcgccgctgtcgatcagcgtctgcgcgatgagggcatccgtgatgaggtttcggtcgttgtcggcggctccatccgcaactccgccgatctgctcaaggccatcgcgctcggcgcggacgcatgctacatcggcaccgcggctctgctcgccatgggctgccacctgtgccgcacctgccagaccggcaagtgcaactggggcattgcaacccagcgtccggagctggtcaagcgcctgaatccggatatcggctcccagcgtctcatcaacctgctcactgcatgggatcacgagctcaaggaaatgatgggcggcatgggcatcaactccatcgaggcactgcgcggcaaccgtcttatgctgcgcggcatcggcctgaccgaccgtgagctgaacatcctcggcatcaagcacgcaggcgaataagcacaggaggtgcgcgaaaatgacaactgtacaggcaggacttacctattataaacaagtaaacgagcagatccgcgcagcgcaggacagcgagatcacggttgagaacgtgatcggccagcgctacatcggctgcggctccaccgaccgcaagatcaccgtgcacggcacggcaggcaacggtctcggccagtatctgaacggctccaccattgaggtcttcggcaacgcgcaggaggccgtcggtgacaccatgaacgccggtgagatcgttgtgcacggcaacgtcggcgacgcctgcggctacgcgatgcgcggcggcaagatctatatcaagggcgactgcggctaccgcgccggcatccacatgaaggcctaccagcagcacttccctgttatggtagtcggaggcaaggcaggttcgttcctcggcgagtatctcgccggcggtctcattcttgtgctcggcatcggtcagaacggcgcgtatccggtcaacaatttctgcggaaccggtatgcacggcggcaaaattgtgttaagatgtgataaagcaccgaccgatctgccgcgtcaggtcctcgtgagcgaggtctccgcggacgatatgaccgaatttgcaccgtatatcaaggaatacgcgcagctgttcggtgcagacgcggaaaatctgctttcgcagaagtatttcgtcctcacgccgaacccggaggctgggtataagcagctttatacctttgaggcttgattttgctctcctcgtttccaactcctgcaaggcaggagttggaaatgaggagatgggagttacctgataggtgtaactcgcaagtgccgtccgtaacaacacgcaaacgaattgtgcgacactgttctgtcgcacctgcgttgatttaaccgtatgtgtagcagaacggtatctgacactgtgtatgggtttcgacaggggagtacactgtgctcccctgcggtagaaaaaatcctctgccgttccccttttcggagcggtcgccgctctctgattttcgccagactatgaaataaaggaaactggagtcccaagaggatagaaaccttggtgtctatccttttggtgccccagccaaggtttggcacccattccgcattctttagcaaaaaatttattcctcaagatacattatgaaaaaggaggcttgccctatggacaccaccatgagcgaagtcgtacaatttattcaggagaacgacgtaaagttcattcgtcttgcgttttgcgatattttcggcaaccagaagaacatcgccatcatgccgaccgagctggaacgcgccttcgagcagggcatccacttcaacgcggcggcgctgcgcggctttctcaatgtagaagcgtctgatctgctgctgttccccgatccggcaacgctttccgttctgccgtggcggccggctcagggccgtgtagtgcgcttttactgcgacattcgctatccggacggcacgccgttcgatggcgacggccgtcatttgctgcgtgaggccaaccgccgtgcgcgccgcgcaggctactcgctgaccatgggcacggcaagcgagttttacctgttcgagctggatgaaaacggccatccaaccaccattccgcacgatcacggcgagtatttcgacgttgcgccgctcgacaaggcggaaaacgtgcgccgtcagatctgcctgacgcttgaggaaatgaacatccagccggagtcctcgcaccacgagcagggtcctggccagaacgaggttgacttccgctacgccgaagcccttgaagcggccgacaatttcgtcaccttcaagtgggtcgtcaagtccatggcgtcctcaagcggcctgtttgcgtccttcctgcccaagccgctcccgcatgcgccgggcagcggactgcatctgtctgtttcgataaacaaaaacggcaagaatctgttccagccctcgtttgaaaaatctgccgagggccagagctttgtggcaggcattctgcagcgtgccgccgagatgaccatcttctgcaatccgctcaccaactcgttccagcgtctgggcgagtttgaagcgcccaagtacatcacctggtcgcatcagaacagccgtccgctcatcaccgtgccgctctccgaggacagcacggcgcaccgcttcaagctgcgtgcgttcgacggctgcatcaacccgtacatcgtatttgcgctgctcatccacgccggtctggacggcatcgagcagggactgcccctgccgcccgcctgcgacgaaaacctgttcaccgcctccgacgaggtacgcgcccgttacgagactctgcccggcgccctgtgcgatgcgatccgcatcgccaaggacagcgactttatcaccaagtacctgcccgaaaaggcacgcacggcctttttcgcggccaagcaggccgaacacgaccgcatcgtgcttgccgacgaccgcacggctgccgaacgctccctctattttgaacgctactaatcccacataataccgtttgaaaggaggagcacaccgcatggaacgcattcttctcgtttctgcaaccgaaaaatcccgcaccatgctttcccagtttttaacgtcctgcggcgtacaggctcagcttgcacctgcttcctccggtgcggaggcccggcgcatgctggtggacggactgttcgacctcgtactcgtcaatacgccgctgcccgatgaatttggccatgatatggcacagcaggctgcaaacgacacgctttccggtgtcatcctgctcgctaaggccgagattgcggacagtgttgccgaaaaggtcgaggacgacggtgtgttcgtcgtacccaagccgctctcgcgcgtactgttcatgcaggcgctccgcatgacgcgcgccgcgcgcagccgtctgaccggcctgcagagcgaaaaccgccgtctgcaaaagcgcattgaggatatccgtcaggtggaccgcgccaagtgtctgctcatcgagtgctgcggcatgaccgagccggaggcgcattcctacatcgagcagcaagctatgaaccagcgtcgctccaagcgagatatcgccgaggacatcatcggcggaaaaacgccgtgatttgtgcgataccgcttaaaaacatctcatatctcacgcgaaaattttttcggttttttcgattttatagagaaattcccgacagattatgatatactaaatggtgtatgagcagagaagctctgtctttccctgcctatatgccatttttgttattttctaaggagggaatccgtgtgaagctggctttcaccaagatgcacggctgcggcaacaattatatctatttcaattgcttcgaccagactgtgcccgatcccgagtcgctttcaatcaagctcagtgagccgcacttcggtatcggcggcgacggcattatccttatttctccttccgacaaggcggatgcgcagatgcgcatcttcaacgccgacggctcggagggaaaaatgtgcggcaacggcatccgctgcgtgggcaagtacctgtacgacaacggcatgaccgatggccgcaccaccatcaccattgacacgctttccggcgtaaaaacgcttgagctgaccgtcaaggacggcaaaatgcagtccgcccgcgtggacatgggtgcagccattcttgctccgcgggagattcccgttgatatggacggcgaaaatgtcatcagcgcacccatcgttgtggacgaaaaggtctaccacatgacctgcgtttccatgggcaacccgcactgcgttatcttccagaaggaggatgtggacgacctcgaccttacgcgcatcggacccaagttcgagcatcatccgctgttcccggagcgtgtcaacaccgagtttgtcaatgtcctgccggacggcagcctgaaaatgcgcgtctgggagcgcggctccggtgaaacatgggcgtgcggcaccggctcctgtgcgaccggcgtggcagcatgtctgaacggctttgcaaacaaaaacgaggatatcgtcgtgcacctgcgcggcggcgacctcaccattcgctatacagatgaaaccgtgttcatgacgggcgcggcaacgaccgtattcaagggggaaatcgagatatgacaaagtacatcttcgtgaccggcggcgtagtttccggtctgggcaagggcattactgccgcatctctcggccgtctgctgaaaagccgcggcctgaaaattgcagcgcagaagctcgatccctacatcaacgtagacccgggcacgatgagcccgttccagcacggcgaggtttacgttaccgacgacggcgcagagaccgacctcgacctcggccactacgagcgcttcatcgacgaggacctgaacaagttctccaacctgaccaccggcaaggtatactggaatgttctgaacaaggaacgcgccggcgagtacctcggtgagaccgtgcaggttatcccgcacatcaccaacgagatcaagtctttcatctactcggtaggcaaaaagacctcggctgacgttgttatcaccgagattggcggcaccaccggtgatattgagtctcagccgttcctcgaggcaatccgtcaggttgctgccgaggttggccgccgcaactgcctgttcatccatgtaacgctggttccgttcatctccggctccaatgagccgaagtccaagccgacccagcactcggttaaggagttgcgcggtctgggcatctctccggacatcatcgtagcccgcgttgaccagccgatggatgacgacatcaagcgcaagatttccatgttctgcaccgtgccggaggactgcgtaatcgaaaaccgcaccctgccggttctgtatcaggcaccgatgatgctcgaggagagccatctgtccgacatcgtctgccgtgagttgtccatcggcgcaggcaagggcgatatgaccgagtggcaggaaatgctcgagcgcattgccgcccgcaagaaccacgttaagattgcactggtcggcaagtacgtcaagctgcacgacgcatatctctcggttgcagaggcgctgcagcacggcggctacgaaaccggctgcttcgttgacattgactgggtagactccgaggagatcaatgactccaccgtggacaagctgctcggtgaggttgacggcatcatcctgccgggcggcttcggcgcacgcggcgtggaaggcatgatctgtgcagcaaactatgcccgcacgcagggtatcccctacttcggcatctgcctcggcatgcagatcgcggttatgagctacgcacgcaacgtgctcggctacgcggatgcaaactccagcgagtttgacccggattccacccatccggtcatcgacctgatggagagccagcagggcatctccaagaagggcggcacgatgcgtctgggcgcttatccgtgcaagatccgtccgaataccatcatggcctcggcgtacggcgaggaaatgatttccgagcgtcaccgccaccgttacgagttcaacaacaatttccgcgaggagattgaaaataagggcatgcagatcacgggcacctcgccgaccggcgagcttgtggagaccgttgagatcccgaaccatccgttctacatcggcgtgcagttccaccccgagttcaagtcccgtccgaaccgcgcacatcccctgttcaaggcgttcgtcgcggcatctctgaaaaggagccagaacaacaatgcagactaacaagaactacgacaatctcgagcagagctatctgttctccaccatcgcacgcaaggtgcgtgagtactccgaagcacatccggaggctgatatcatccgtctgggcatcggcgacgtaacccgtccgctggtaccggctgttatcgacgcactgcacgcagccgttgaggatcaggccaagcaggagaccttccacggctacggcgatgagcagggctatggcttcctgcacgaggcgctggtcggctactacaagtcccacggcgtagagctcgccaccaatgagatcttcatctcggacggtgcaaagagcgacctcggcaacatcctcgacattttcggcactgacaacaccgttctggttccggacccggtttacccggtttacgttgataccaacgttatggcgggccgcaagatcgtattcgctgacgcaaacgaggcaaacggcttcctgccgctgccggacgagtccgttcagtgcgacatcatctatatctgctctccgaacaacccgaccggcgctgcttacgaccgcgcaggtctgaaggcttgggtagattacgcaaacaagcagaacgccgttatcctgtatgacgcagcttacgagtgcttcatcgaggatgagactctgccgcgctccatctacgagattgaaggcgctaagtcctgtgcgatcgagttctgctccttctccaagatggcaggcttcaccggcacccgctgcggctggaccgttgttccgaccgctctgctggacggcaagctgaacaagatgtggctgcgccgtcagaccaccaagttcaacggcgttccgtatatcgtacagaagggcgctgctgcctgcttcactgaggaaggcatgaagcagatcaaggagaccctcggctactacaagcagaacgctaaggttctcgctgcgaccctcgatgagctgggtatctggtacaccggcggcaagagcagcccgtacctgtggctcaagtgcccgaacggcatggattcctggaccttcttcgactacctgcttgagaatgccaacgtcgttggtacgccgggtgcaggcttcggcaagaacggtgacggcttcttccgtctgaccgcattcggcgatcaggcacgcaccaaggaagctgctgagcgtctgaagaagctgctccagaagtaagtttccgcaatatcgcataatcaaagagctgtcccgcgcggacagctctttttgcatagttgaggtgattcgatgggcattctttatggtcacaggtgcgttttatgcggcgcggattttccggtgacgaccagccgcacgctgcagctttgtccggactgtgccgctgcagtccggcgggaataccgctgcaatgaggtcatctccatcgccggagcggacggtacgatcgctccgctgtattaccgcggcacagtacgcaatgccatgaaacggttcaaattcagcagcgccgcctactgtgcggactggttcgcggcgcaaatgtccgtggctctcaccgcacggctggacgactggcagccggatttgattacctacatgccgattggatttctgcattaccgcaagcgtggatataatcaggcagaactgctcgcaaagctgacggcaaagccgctttccctgccgtgcgaggcaacactgcgtaagcgatggtttgtcggcaagcaatccgcgcagaaggattacgccgcgcggcagagcaacgcaaaagatgccgttctgccgaagggcggcgtggatttgaccggaaaatctgttgtgctggtcgatgatattatcaccaccggcgcaacggcggctgccgccgtcaaggctctgcgggagatgggcgcaagccgtgtttacgtcctcgctgcgacatttacaccggggaaataacaaaaaagaccgcgtaagcggtcttttttgttagtcaacgtctgcggtatagagtttatcgaaattatccagcataacgaccttgacgcggtattcacccagttcaccttccagattgcgccagtttacatcggtgtagaatgtgctgtcgcccgtaaaatcttttatatcaatcggctgcatatcctgcacttttccgttccgatacagcacaatattgctgctggcaggcttaacatcctcactgctgcagtaaactctcacttctactccgccgctgacggtggtagtcggatttttttcgccgatgctgcttataccaccattgttccaatgcgctgtcacactcagccggagccgctgttccaaatcatattcagatgtaaccagaatattgcgcgtctcaccgctcgtgcctgttaatgtcaaatagacagaaaacgtatccacaaacggcacactcagttttccactgtacccgttattatcctccgcgtcgcactcccacgactggtcaccgctgcggacaacgaattttgcggtttcgccgtccagcatactgcgtggaactgcgctcaccgtcacaagaaggttatccgtgttctgtgggtctacggtcacattctccgaccagtcggctaaatcgctattctcagcgctcgtattatccggatagtaaatcgtactcggcccgctctgcatccgcagcgtgtcgatctgctgctgcatggcgagcacgcgccacaggctgaccgcgctgcacacgacgctgacgcacagcagccctgccgctgcgattgccgcaattttccacttgcggttctcgttcctgaccggctggttctctgcacccggccacgattcatccgagtcctctgccttcgacattagctccgcatccggacgcagcaacgtatccaccggaacgccgaacagcttgctcaattccattaaattatccatcgttggcaccgcctgatcggcctcccacttgctgaccgcctgacggctcaggcccagcttttcgccgagcgcctcctgactcatgccctgctcttttcgcagcgccgtgattttctcacctgttgtcatttctgccacctgcctttcttttctgtctccagtgtgcctgaaatgccgcaaaaacgccaccaacccatcgtttctttttgtcaaccgacggttgcggacgtctttccggttgcaaaaaagtcccgaaatgcacatttcgggacttttgatatactgtatcggttaagcgttgaagaactcctcgtggatagccttaacagccttctcgctgtcctcctcgttgatgaggacggagatcttgatctcagaggtggagatcatgcggatgttgatgccggccatagccagagcctcgaacatcttggaagcaacaccggtagcggaagccatgcctgcaccaacgatggaaacctttgcaaccttggtgttgatggacagatcctcataaccgagcatctccttcgcgtcgcgcagaatagactctacgcgctctgcatcgtcctgacggatggtgaaggaaatagacttcttgttatcgcggccgacggactgcaggatgatgtcgatattgacatggtgcttcgccatcagcgagaataccttgaacgcggtacccggcgtatcatccagattgatgatggcaactcgtgcgcagttattatcacgggcaacacccgaaacattcaatttttccatgttagaaccctccttgactttggtacccggattgcgggtaaagctcgaaacgacctcaagatcgacattgtacttctttgccatctcaaccgaacggttgtgcagcacctgtgcacccagagatgccagctccagcatctcatcataggtgatggcgtccagcttcttggcatcctttacgatacgcggatcggcagtgtaaacgccgtctacgtcggtataaatctgacagagatccgcgccaagcgttgctgcaatggcaactgcggtggtgtccgagccgccgcggccgagcgtggtcacgtcgcccatcttgttgatgccctggaaaccagctacgataacgatgcggccgttgtccagctctgccttgaggcgatcgcccgcgatgcgcttgatgcgcgcgtccgagtaattgctgttggtttccagaccaatctgccagccggtcagggatacgaccggaaagcccagcttctggatggccatcgccagcagagacatggagatcatctcgccggtgttgagcagaacgtccatctcacgcttagaaggacggtcgttcagctcggcagcctttacgatcagatcatccgtggtatcgccctgagcggatacaactacaacaacctgattgcctgcctgtgcggtcttggtaacaatgtccgcaacattcttcagtcgctcggtgttggcaaccgaagtgccgccgaacttttgcacaataagactcatactaactatgtttcctccttatatacacggacgagagcactcatccgtcccctattacagtcgttttacggtcgcaccgacctcatcacagcgcagctgtacggccttccagtgcggatacagcttctcgcacagctcctgtgcacgggtgatgtagtcgcggtcgcccttgtagacaatcgccacgatggacgggcctgcaccggaaatgaaagcgccgagtgcgcccagcttcttggcctcacgcacgatgtcctcaccgttttcaatcagaccgaaacggtacggctggtgcagacagtcaccggttgccgcatcaaggttttccagcttgccggtggtcaggctgcccgcgagcagcgctgcgcgcgccagattgtaaaccgcatcgtgatggtcgatggtcttgggcagcgccgcacgcgccttttcggtggacagctggaaatccggaatgaataccacgaagtcgatcgcgccgtgtaccggcacgcgaacgtgatgcacatggccgtcctcgagcagcgccacacagaagccgccgaggatagcgggcgtggagttatccggatggccctcgatcgtggctgcaaggtcgatgaccgcattgcggtcgagcggctcaccaagcagcatattcgcgcccatgatgcccgcaaccgtgcacgccgaggacgagccaaggccgcgggtctgcgggatagcgcagtcctcaacgatagtcaagccggaaagcggcttgccgcactcgtcgtagacgcgctttgcacactgatagatcaggttgctctcgtcctgcgggacgtactgaccatttttatccgaaatatcaatatgatcgttctctgcgaggtcgatcacgttgtacagctcgagcgcaatgccgatgctgtcatagcccgagcccatattggcgctcgtagcaggaacggttacacgaaccattgtatttctctcctttacagaatacgcattgccgcacgaacttcaccgcgttcgttcagcttttcggctgcggcgttcatctctgcggtggacagcttgcgggtctgaaccacgaatacgccctcagcaggctcggtcagactctcaaccggcagcagttcctcaacatccttctgtgcgcccttgaagcgaacgtaccatgcactctgcagggtatccagcggacggagcagattcttggagccatcgccccagaagatacggcggcggttgtccttgtgctcgatgctgtccagcatatcggcaacaacagcggaagcggtcgccagcttgccggcgcccttgccgtagaacataacctcgccggtcgcattgccgtcgatcatgatggcgttgaatacgtcctcaacagcggccagcgggctttccttgtggatgagatgcggtgcaacataagcgtaagcggtgccgtcctcgcagcggaccgagcggcccagcagcttgataacgcagcccagcttgtcggcgtttgctacgtcctcgagggtgatcttggtgatgccctcgcaggaaacctgatccgggtcgaacttgtcgccgtaagcgaggtcggacaggatgcagatcttgcggcaggcatcgtgaccctcgatgtcggcagtcggatccttctcggcatagccgttgagctgtgcctgcttgagcgcatccgcaaaggtaacgccgttgtggatcatctgggtgaggatgtagttggtcgtgccgttcaggatgccgcagatttcgttaaactcgttggcagccaggcactgcagcatcgggcggatgaccggaatgccgccgccgacagaggcctcgaacatgtagtttacgccgtgctcctccgcaatcttgagcagctcctcgcccttggttgcaaccagctccttgttggaggtgcatacgctcttgccggcctcgaggcagcgcttggtgaactgatatgcagcgcccacgccgcccatcacctcggcaacgaccgttacctcggggtcgttctcgatgacggagaaatcggttacaaatttattgccatacggcagagaggaaaagtcgcgcaggtcgaggacgtactttacctcaaccggctcgccaacggtctttgcgatcttgtcggcgttcatgtcaaacacctcgtatacgcccgagccgacggtgccgtgtcccatgattgctactttaatcatatgctgatttcctttcatcagttaaattagcgttctgtataccgtcggacggtcattcagatgccagaatttccactttgctgacgccttccattgcttctgcgcgatgcacaagctcttcggatgagtatttcatctcaccggtgcgggccgaaatagtgaccgatgccattcctctcatcggaatggactggttcaccgtcagcaggtttgcacccgagcgtgccatcagtccgaggatgctcgacagaacacccggctgatcgtgcagcatgaaatggtaggtgacaatgcggtcggtagtcgcctcaaagaaagggcgaacgccgtccttatatttgtagtacgcactgcgcgacagaccggcgatctttgccgcttcgcttgccgtagccgccttgcccgaagcgatggcttcattcgcttcgatcacgcgctgaaatacctccggcagcagagtgcgctccacgagataatactttggttttaccatgcgatgtctgtccttcctaaaaagacacttgtctttttcacgctcatctatcataccatatccatccaccgagcgcaagagaataactgataaatttccctaaattccgacgagcgttttgttacttctgtcaaaagctcccgcttttcctgttgaaagtacaagtggctttttactttattttgtgttatactaagtatatacttgtaaacaaaccggagaattttattatgcatcagaaaaatggaaacggcactttcacctcaaagctcggcttcgtgctggcggctgtcggctcagcggtcggcatgggcaacatctggatgttcccctatcgcaccggccagtacggcggcgcagcttttttgatcccctacctactgttcatcgcactgttcggctatgtcggcctgtccggcgagttcgccttcggccgcatgaccggcacaggtccgatcggctcgtatgaatttgcgatgaagtcccgcggcaaaaagggcggcgccatcctcggtacgattccgctgctcggctcgctcggcatcgccatcggctacgccatcatcgtcggctgggtgctgcggagcgcgttcggtgcactgaccggctcgctgataagcaccgaaccggagcagttcttcacggaaatgagcagcacgaatttttccagtgtgccgtggcacaccctggttatcctgctgacggcggctgtgctgatcttcggcgtgtccggcggcattgaaaagatcaacaaggtgatgatgcctgcgttcttcatcctgttcatcattattgctgtccgcgtagccttcctgccgaatgcgatcgaaggctacaaatacctgctcgtaccgcagtgggagtacctgttcaacccgcgcacatggatcatggcgatgggtcaggcgttcttctcgctgtcgatcaccggctcgggcatgatcatttacggctcgtacctgccgaagaacgaggatgtcgttcactcgtcctgcatgacggcggtgctcgacacctgcgcggctatgctggccggcttcgccatcctgccgagcgtgttcgcgttcggtctggacccggcctccggccccaagctgctgttcatcaccctgccgcgtgtattccagcagatgccgttcggccgtctgttcgcgttcttcttctttatttccgtgctgttcgcgggcattacctcgctggcgaatatgctggaagcggtctccgaagccgcgcagacgcgcctcaagctgagccgaaaggccgctgtcctgctggcgtgcggtgcggcgctggcggtcggcctgtttatcgagcgcgatacgctcatgggtacgctgatggacgtgattaccatttacgttgtgccgatcggcgcaatcctcggtgcggttatggcgtactgggtgctcggcatcaacaagatggagcaggagctgatgaacggccgcagcaagccgctcagccgcgcgtttgcgccgcttgcgaaatatgtgtatatcttccttgccgcactcgtcgtattcttcagctttattatcccgggcggtattgggtaaaccctgtgcaatcaaaaaggacttcctgcgggaagtcctttttttcatgctatttcgtgcagtaatggagaattgagaattgaaaatggaaaattaacgcgatggttgcgttttccgcatcatttgcagacgctttgttcaatggaaaacgccccatctatacgttcattctccattctccattttcaattctccattcataacgattcatcaaggaagaaaatctcctccacgggttgttccagcagccgtgcggttttaatcgccagttcgagggtcgggtcgtacttatcgttctccatcgccacgatggtctgccgcgataccccgagcagctttgccatgtcctcctgccgcaggccgcgcgccttgcggagttctttaatgttgttcttcatcttcagcgccagaacttccatatcaaatctgcgaatatcacgaccggaatgaaaatacgctttacaatatccccagcgagcgcacttttagacggcggatcttcctcgtcgtcttttgcggcacggtaggtcgcgattgttctgtaaacaccctcgaacaccatgcacacgaaccacagaatcgcaaactcgctcacatttttgccgaatgcaatgatatccaccagcatcaccacaaacagcccgaccgtcatcaagcgataggcgataatcgcaccattgcgtgtgatcgtgttctgcatttcgtcctgctcccagccgttagccttcgcggaagcgcgtgcacgagcggttttcccggcctgaccccagtcttcccagagcataaaagccagccagaatgccgcaaaaacaatcattacgaccacgccgataccggtttcggctgtaaacataggtgcacctcctcacatccagaaaaccttgaccacaacccacagatacatcagattattgaacacactatgtcccatctgtttccacatttgcgttttatcctcatcgcccgccatattgcgaatggttttgatgataataaacagcacctcagcaacaatggacacgattgccaagacactgagttcaatcgagcgataatcacggaaaaggcggctgtaaccaagataaatgataacaccggcctgcagcacacggtatccaatcaagcgacccttcacattgacggcgtgcgccatctcatcaatattccattcccagtccttcatgatttttctcgctcgcggcgattgtccttcttctacccagtcgtgccacagactcgctgcaagaataaccagcggcagcacaatcgcaaccacaacaacctgcaccttctgtgtcatatcgtacatatcccagctcataagcgcacctcctaccagttttgcgttagaaccgtcattccgacggccaatccgatcagcaccgcacagaacgtcagctttgcgataaggaaagccagtctcggcggatgctcctcgtcgtcccgcgttttgcggaaggtctgcacgagcatgatgaccacctccgtcatcgaagaaaccaccagcaggacgcacagctccgccgccggctgtccccacacgagcaaccgcagatacatacagaccagaagcccggtctgtgtcacacgatatgcgatggcctgcgcctgtgtgatgatggcgtgctccatctcatcggtcctgctgccgagtgctttggcggctttgcgggcctttttcgatcctccggcatccatccagtctcttaccagccatgccgccagcaggagcaccggcaggccgatgcagacccacaatacctgcattttctcggctgatgtgtacaaatcccaccgcataaaagcacctcctgcccttgatgccattcgctaaaatgtaaagttctctttacatcttcaagataacaggcagacagcaaaatgtcaagagtatttgacatttcaggtaaggaaaaaccccacagaattttctgtggggttttgtgaatgtttactgatcctgcttatccgggtcgagatccttttcggcttcttcaaccttggcaagctcctctgcggattccgcaggcttgcttaccttggcgtgcagctcctgctgcagctcggtcatcagatcctcgccgacgatcttatccggaacgatttcgccgttgtagaccttaacaaaggtctcgccgtccatcgtttcgttacggatgaggtactcggcaacgcgcttcatctcgtccatgtgctcgctcagcagcttttcacaggcgtgatatgcgtgctcgataatgcggtgaatctcgtcgtcgatctccgccgccttaacctcggaatagcccttgccggctgccagatcgcggccgaggaacacctcaccgttatccgaaccgtagtcgatcgggccgatacgctcgctcatgccgtagctggtgaccatggcgcgtgccatctgggttgcctgcttgatgtcgccataagcaccggtggagatatcctccatcgtcagctgctcggccacgcggccgcccaggcaaacgataatgtactcctccatatacttcttggtgcggtaggcctgatcctcctccggcagcggcatggtaaagccgcctgcgccggacgaacgcgggatgatggtaacatggtgtaccggatcctgcgtcggcagaacgtggaagcagatagcgtgaccggcctcgtggtacgcggtcaggcgcttgtcgtgctcgttgatgatgtggctcttcttctccacgcccattacaaccttgagcagcgactcctcgatctcctcctgcgagatcagcttcttgttgcggcgtgccgcaagcagcgctgcctcattgagcaggttttcgaggtctgcaccagtgaaaccggcagtcgtcttggcaatttcagagaacttgacatccgggtcgaactgcttgttgcgggcatgtaccttgaggacagcctcacggcccttgacatccggtgcgccgacatagacctgacggtcgaaacggcccggacgcagcagcgcgttatccagaatatccttgcggttggtggctgcgatgacgataacgccctcgtttgcaccaaagccgtccatctcaacgagcagctggttgagcgtctgctcgcgctcgtcatggccgccgccgagacctgcgccgcgctgacggcctaccgcatcgatctcatcgatgaacacaatagccggtgcgttctttttggcctgctcgaacaggtcgcgcacacgcgatgcgccgacaccgacgtacagctcaacgaagtccgaacccgaaatagacaggaacggtacgcccgcctcgcctgcaaccgcacgcgcgatcagggtcttaccggtgcccggagggccgaccagcagcacgcctttcggaatacgcgcgccgatctgcacgaacttctgcggattcttgaggaactcaacaatttcctgcagctcggccttttcttcatccgcgcctgccacatcattgaaggtgaccttgcgcttatcgtcctgcgccagctttgcacgggccttgccaaactgcatcggacctgctccgccgccggactgcttgttcatcataaagcaccagaacgcgatcagcagcacgatcaggatcacatacggcaggaactgtgcccaccacggaatggtcgccgtgcggtaatcgaccttggtcagcgtgccatcccgcatctgctgctgaatagtctcacccagatcattatagaacacgcttctgtagtcgcccaaatcgtaagtgtacgtctggttttcctttttcagatgcatggtcagcgtggtgtcgtccacgtcgtactggtcaacatcgccatccataaagtagttgtagatctgattataggacagcgtttctgtctgctgtgtctggctgaccacatagctgacgcccgccagcaggcacaccagtataatcaggtaaaggccgaagcctttcattttgcctttcaaatcggtttaacacctcttccctaaattactcgccgccgtaaacatacggcttaagtatgccgatatacggcagattgcgatacttttccgcgtagtcaagaccgtagccgactacgaactcgtccggaatctcaaagccgagataatccacatcaacctgaatcttgcggcgctccggcttggagagcagcgtgcacaggcggatggaatttgcgccgcgtgctgcaaggatctgcatcagataatgcagcgttacgccggaatccagaatatcctcaacgatcagcaggtcgcggccgtcgatcggctgtgcgatatccttgatgatctgcacctcgccggaggtcttggtgcccttgccgtagctggatacgaccatgaaatccacgttgcacggcgtatcaatggcgcgggtcaggtcggccatgaacacataggagcccttgagcacactgacgatcagcgggttcttgtcgcggtagtcctccgtgatacgcgcacccagctctgctaccttttcgtgaagctgctcctcggtaaagtaaacttccttgatgtcatctcgcatattataagccatttttcgataacccctttactgtaatctgcagtgtatttgcgttatttttggctgttctgctgcaatccgcaccgatatcctgcaccgcgatcacgccgtttttatctgcgatgacggccatcgcattccgcatatagcgcggaatctttcggtcgatcatcagctttttgagcgatctgctgccgccgttttcggtcagccgcagagtgtctccggtgcgccgcgtgcgaacacacagcgattcaaaatctattgtaccacaatccagacaaaaagtattgaatgttttgtaaaaaacttcggatttttctaatttttttgcggcgagctttaccgtgtccttccagatcgtccctgcaaatggtagggtaagcgggatttccggccgctcgaccgcagtttcagccttgggaatgatgcgcagaacatcatattcacgtcttgcgaaatagccgttcggcaaatcggtttccgcagacggagacgcggtttccaacagatgctcgagcgcagtaatatgctttgcggttacgtctttaagcggcatatccgcattttcgagcagcagccgcagcgctcggctgcgaaccgccggtgcggcttcccgcagaggctgaatcttccacgcgccgttcccgactgcacaaagttgtacacaggtctgtgcataactctgcaggcaagtctcgtcctgccgaagctgacgcgaaagccgtgctgccgcctgcgccgcctgcggattcaattcccgcagaacgggaacgacctcttgacggaggcggttgcgcgtataaactgtatccgcgttcgtgctgtccgtgacgaaatcctgtccgcgctcgcgcagaaaggcttcgatttcccgccgctcaacctcgatgagaggccgaatgatgcgtccgcgcaccggcggaatgcccgtgagacctttcgcacctgtgccgcgcaccaaatgaaacagcatggtctccagattgtcgtccgcattgtgcgccaccgcgattttggctccgtgcgcggcatgctccagccgtgcatagcgaatacgccgcgcggtctcctccaccgcggaatcgcctgcggcagcggctatgtccacgcgctcgaccgtcagttccacgccgagcttctcacacagcctgcggcagaaggcttcgtcccggtcggactctgcaccacgcagacagtggttgaggtgaaatgcccgcaccggataccccagctcgcgcagactcagcagaagcgctgcggaatccgcaccgccggacagggcgaccagcacattttcgccggtttcaagcatcatatagttggaaatcgtccgttttaccgtatccagcatggcttactcctcgtgaatgcggtccggattggagaacgtggtatactgaccgacccactgcagctcaatggtgccggtcgcaccgtgacggtttttcgcaatgataatttctgcgatatttttattttcgctttcatcatcgtagtaatcgtcgcggtagataaacataacgatgtcggcgtcctgctcgatcgcgccggactctcgcaggtcggacagcatcgggcgcttatccgagcgctgctcggacgcacgcgacagctgcgacagacacacgaccggaacattgagttccttcgccataattttcagcgaacgcgaaatctctgcgacctcctgcacacggttatccatgtggcggccgccgacgtgcatcagctgcagatagtcgataacgatcagaccgagttcgtcacccagtctgcggcatttcgccttgatctccgcaaccgtgatggccggattgtcgtccacatagatattcagtcctgccagcacgccggacgcacgcgcgatctttacccagtcgtcaccgtccagattgccggttttcagcttctgcgactcgatgagtgcctcgctcgacagaaaacggctggccagctgttccttgcccatctcaagctggaacacgcacacgccagtgccctttttgtcgccgcgctccttattcttgacacttgccttagccgcattgagcgccacgttgagcgcaaatgcggtcttgcccatgccgggtcgtgccgcaatgagaatcaggtcggatttattgagaccggtcagcgccgtgtccagcgcgtggaagccggtggacatgccgggaatttcactgtccgaccgggcacgctcgtccagttcggtatacagatcggcgataacctcagaaagccgtgacaggcccttaatttcacgtccctgccggatgctgtaaatgcgctgctccgccagctcggcaatgccggaggcttcgccgtgggcttcgagggcgttctgctgaatctcgctgcccgcatccgccagctggcgcagcaggctcttgtcacgcacgatgcggacatattcgttgacgttccgcgcacccggcgtgacctccatcagctgaaagagatacgcgcggccgccggcctcgtcgtagtagcccatgcgcgtgagcatatccagaacggttaccgggtcaatacgctgtgcgccgttgaacatcgagtagatggtctcaaagatgcgcttgttttcttccgcgtaaaaatcatcggcgcgcacctgctcgatgacctcaggaatgcagttcggatcgaccagcatcgcgcctaaaagcgactgctccgcagtcagatcctgcggcacctgccgcatcaaaagttcgtcgggcacttacttacctccctccgctaacaaattgaaaatggaaaatggagaattgagaatgaggaacaaaaaatgacaacgcaggcatcgcctgcgtcaatcaaatcccgctttgcttgcaaagcgcaacctcagatgcagccgtaccgaatggtacggcgagcatctcggtcccgccgcagcgaccgtgcgttccacgcacggcatgaaataggacacggcattgccgtgtccgtaaaaagtcgcgacatgcgcgtgactttttacaccccgacccagcgctcttggagcgcgtccgggggtatcgccggtcggtttctccggaaccgaccggcgtatatagggggtattggataccccctataggtgcaggttacgcctcgactacctgcaccagaatctcgcctgcgatatcctgatacagctttgcctttacgcggtgtacaccgaaggtcttgatcggctcctcgagcacgatcttctgcttcggtacgttcagaccgtactgcttgttcagctcctcagcgatttccttggaggtaacagcgccgaacagacggccgcccgtgccgcccttggccggaacctttaccgggctctccttgagtttctcggctgcctcgcgggccgcctgctgctcgagtgcgatcttgcgtgcgtgtgcctcatcctgcgccttcttgacgttcaggttatccgcggttgccggctctgccagaccgcgcggcatcaggaagttgcggccgtagccctcgctgacctcgatcagctcgccctttttacccttgcccttaacgtcggccttgagaattactttcatgatgattactccttttgtgtgtactgagggcaaaaccgctcttgttcaattatgcggtattgccctatatcgaatgcggcgaacagcttcgcctgcttttcggtctgattacggctgtcgtgaaacgccttttccgacagactgttatttgttgtcgtcctgcttctcggtccgctgatcgtcgaagtagccgcgaatggcatccgtgatcagcttgtcggcctcctccggcgtggtattcttcagctgtgcaccggccgccgaatggttgccgccgccgccgagtctctccatcagcagctgcacattgacgtggcctgccgcacgagcggaaaccgccatatcattgccgctgcggaacgcaacaacgcttgcatgtgtgccgatgatggacagcagctcgtccgctgcctgtgcggccgcgatgcggtctacctcctcaccggtgatggcaaagataacaccctgaccgcagtcgcgcgcggaggaaatcagcttctggcgctccatatactggtcaaagctggactggaacagacgcttgacatcgctcgactccgcacctgcgcggcgcagatacgctgccgcctcaaatgtgcggacgccggtgcgcgttgaaaagcccttggtatccagataaatacctgccagcatggcttccgcctcgcaggtgagaatgccgctggtcggcacaagatactgcagcagctcgctgaccagctcggatgcggacgacgcatacggctcgtgcagggatacgactgcgttctcgatataatccgccgcacggcggtgatggtcaatgactgcgatcttgttgatagattcgagcagcgccgcgctctccacatagccaggacggtttacgtccaccacgataagcagcgtgttgaaatcgcacgcgatcatcgcatcctcggcgctgatgaacacacccttgtactcagactgggtttccagccgctcgatcaggtcacttgccatggtgtgctgacggtccacaacaatgtgcaccggtctgcccttgacgcgcgcggcacagaccataccggcagcagcgccgatggcgtccatatcgctgttcttgtggcccatgaccagcacctgagacgagtctcgaatcagctggctgagtgcgttggcaaccacgcggctcttgaccttggtgcgcttctcgacttcttcgctcagtccgccgaagaaggcaaagttaaatttattcttgataaccgcctggtcgccgccgcgggacagcgccatgtcgatagcgagtccggcaaactgatagctttccgcaagcgtttcgccgtcgcgtccgataccgatggacagagtagctacaacgccctcgtggttctcaatctcgcgcacctcctgcagaacggagaacttgcgcgcgaccagcttgtccagctcggcgctttcgatcacgaagatatacttgtcgcggtcgtacttgcgcagtacggcgcttgagtccttcacccaggcaaacagacgtttgtcaatgcccgccagaatgttggatttttccgagtcagtggtattcttgaccagatcctcgtagttgtcgatcgcgataaccgcgatagccggacgggtagtctccgctgcgtcgcgcagacggacaaactcggtgcagtcgataaaatgcagcatcatcagctgccccgcaccgctctgcaccagactgccgaatacatggtactgtcgcttgccgatgccaagctcgcccgggaacgcggtctgtcccttgatgagccagccggtctcaaacgtcggtgcgatctcgcccatgcgaacgccgcttaccgcagtccctcgaccgctgatttccgcaaatgcgtcattcgcccatacgatctcacccgtggtagccagcgcgacagctgtcggcagcggcgagcgtgtcaccgccggacggatctctccgccgtctacctcgatgttgttcatcagttcctgcacctgccgctgccgtgccgcattcgtacgcagcgaaacaatccgcaggatgatacacaccacaatacccgccgcaccgtacacgcgggagaaataaagtcccacgaccgcaaacaggaaaaacagcacataaaacattacgctgttgggagccagcatcttctgtaatctctttttcaaacccctgcctcctttttgggacgcaaatattcaacctaattatagcaagccatcgccagaatttcaacactaaatgcaaaccggttttgtatcttttcgccgtccgcttgcaattttcacagcttcatggtacagtaaccgtagattcgcaatcaggaggatatcattatgcaattttcgtttgcacacaacaacttcaacgtccgcgatctggaccgctcgctttctttttataaggaggctctcggtctgaccgaatccagccgtatcaacgcaccggacggcagcttcattattgtatacctgaccgatggcgtaacgccgcatctgctcgagctgacgtggctgcgcgactgggacaagccgtacaacctcggtgacaacgagttccacctggccttccgcgtggatgatttcgatgccgcacacgcaaagcacaaggaaatggactgcatctgctttgaaaatccggcaatgggcatctattttatctctgacccggacggctactggctggaggtcattcccgcaaagtaaacagaaaacgcttggagctgctgctttgagcgttttttcatcctcttaacaggattattctgttcatttttcgacaacgggtgtatactattgaagttatctcctgacgaaaggactgtatcatttgaatccttaccttgatctatacctcacatttgcacggattggcgtatgcacgttcggcggcggctatgccatgctgccgattctgcagcgcgaggtcgttgaaaaccgccactgggcgactgaggacgagctgatggactactacgccatcggtcagtgtacgccgggcgttatcgccgtgaacacgtccacgttcatcggctacaagacgcacggcattctcggcggcattgcctccacggcaggcatgatcacgccatcgctgattattatcacgatcattgccgcatttatccagcagtttgcgcatctcgctgtcgtgcagcacgcatttgctggaatccgcatcgcggtctgcgcgcttgtgctgcagtccgtgtggaaaatggcgaaaaagggcgttgttgacgttccgaccagtgttatcctgctcgttacgttcgcggctgtcgccttcttcggcgtttctcccgttgtgatggtcgttatcgccgctgctgccggtattatcatcggtatgatccggaggaagcgcgcatgattttccttcagctgttttacgaatttttcaagaccggtctgttcgccatcggtggcggactggcgaccctgccgttcctcaagcagatttcgctgcggtatccgtggttcacgccgaatgatctgatggacatgattgcgatctccgagtccacacccggtccgataggtgtcaactcggcaacatacgcaggcttccacgcagccggcattcccggtgccatcacagcgacctgctcgcttgtgctgccgtcggtcatcatcatcattctggtgtcgcgtgcgctcgataagttccgcgactctccgctggtcaagaacggcttttacggcctgcgtccagcgtccgcgggtctgatcttcggcgcaatgctcgaggtgttcgccgcttccctgctgcacacggaaaactgggccggtattgccagcatcggttcggtcatcaatgttccggcgataattattttcctcgtgctgtcgctcggtatctggaagctcaaaaaactgcatccgatcgtgtttatcctgatcggcgcggtatgcggcattgtgtttaatctgtaagttttgatttgttatcgtgcagattctctgtggaacggcgggatgaggcagcccgccactgccctccgaattgcacaaaaaaatccctttctcagtcgagaaagggattttagcttgtcgaaaaagcaatatttgatttttatgcttcgtgcggcagcacgcattcaatcgaatttgctttgcaaattcataaattccgggagcatgtatctcggaatttatacaagggaagaaaaaatgtgtccgcaggacgcgatttttcttcgagattcgctcgaaagcgtggtttcgagcgagaggctgttcggaaaacaaagtttttcgacagcctcaaatccctttctcagtcgagaaagggattttctttttatttcgtgaggtattcctcaatcaactcacacgcatcctcaatgcagcccgggcaggagcgccgaacattgccgtcggctacgcccttgaggtcgcggcacagatacgcgccgttcttctgttcaaacttctccttgagcattttcgtgaccttataggtctgacccttggtcgtgcccggcttatccgctcctgcgctgttcttcatgcccgcgagcatgaacgcaccgctcagcgcgccgcacatctccatgcagcccatgccgaagccgaaaccttccgacattttataggcggtctccttatccagaccaaccagatcgcagtacgcgcaggccaccgcctgtgcgcagttgtagccctgatcgtgaaaatcctgtgccagttttgcccgttctgtcataacaaatatctcctttttcaaagcaaaccgcgccgtaaacgacgcggtcaacttacttaataccgcacctgtgtgaaataatacaggattgcattgcactgtgcacgcgcctgcttctgccagtcctcctcactgtcgatgaacttctggtcctcctcgttatcaatgaagcagaattcactcgtcagcgccggaatattcagcgccgctgctgcacggttggtgtaataataatcgccgtgactgccctcgcggaacacgatctggcgaatcggaacacccagcttttcgtactcgtcgagcagcgcctgcgccagaattttggtcggtccgccgttcttgtccgcaatctgcgccagaatttccgcgccgcgtgcagtggtgttggctgcattgtggtggatactgaagaacaggtccgccgaggacgcatactgtttcataacagcgccgcgcagcgtcagctcgctgccttcctcaagggtatcgcgcaccatgataacctttgcaccggctgcctcaaggtactgcttgaggtactgcgccacatacaggttgacgtgcttctcatcgagcgaaccgccgttgttcgcgccgacatcgctgccgccgtgccccgggtcgataatgaccgtcatcacgccgtcaatgtgcgaggtgcgcggcggctgtatcggatcgttatcctcgtcgccgctgacgtagtcgcgcacgcgcgtcaggtaagccgcgctgcagtagcggccgctgcccgaagagttatccataatatgcgcccagccgttgctgatactgtcaaccgcgatttccgcgccgtttttcagcacgccgaccagcgtgccggaggtgctcgggctcgagcgaacagacagctcggaacccacggttacacgatacacgccgcttgtgaacgtctcggcgggcgtatccggtgttgtcggctcagtcggtgttgtcggctcagtcggcgttgtcggcttgtcaggagtcaccggtgtactcggcgtcgaaggtgtgctcggtttggagacagtcggctcggtctgcttatcgaccgccgcattgtaatcccttacgcgcaccagatagtctgcgctgcagtaacggccgctgccgcctgcgctgtccagcaggtgcgcccagccgttcgacagcttgtccacgataaccagtgcgtcctttgcgtactcgcccagctcagaatagccggttcccggaccgctgcgcacggtcagcgccgaatggacattgacgcggtacacaccggtcgtgaacgaagccggagtcggtgcaggcgtcggtgttttgagcgaaaccgtgcggctgggtacgtcgtaatccgccgtaaagccgagtgcggccgccatatcggctatcttgtagtagttgtttccgttgatgatgtaaccgtcaaacgaaacctttttgccgttcaccttgacgatagccgtggtgggtttgcctgccgcgctggacagtgccttcgtgttcagctctccgccgaccgcggtgtaatttttgccggtcgtcagggtgataacgttggtggacttctcccagcctacctcaaactctgcggtgctgttgcgcagcagatacgctacatcgcgcagcttaaaataattatacctgttaattaagtacgcctgcggattggtcaccgccttgccgttgagctgaaacgcgtgcgtggtctttgccgcgctgacgactgctctcgcctgcggcagatcctgtgtcagatcccgctcggcggcagtctcggtcgtgacggctgtggtctctgtctccgcggcatcctgcggcaattctgcggccgccgcacccgctgtcatatatatcgccgcactaagcaatgccgcgatcattcgtttgaaacgcattcttgaacctccatgctgtttcgccggtgggttgctttcctgcatgcccgccgtgggcattcttgatggtattttaccacaaaacatggcacatttcaacgaaatatgacgaaaccggggcatttgtaatattacaaatgccccgattattccatataagtacaatatttcgttaaatctcttccatctgcctgttgatggaatcctcgcaggagcgcatggcatccagtgtctgctgccacagctcctcgagcgtcagtccacacagctccgcgccgcgctcgatgacctcacgcgagcagcctgccgcgaactttttatccttgtatttcttcttcaggctcttgagctccatgtcctgcacgctcttggacgggcgcatgagcgctgccgcaccgatcagcccggtcagctcatcggctgcatacagcagcttttccatctcgtgctccggcttgatatccacgcaaattgcccagccgtggctgcataccgcgtgaatgatactctcgtctgcaccgccctcgcgcagcagctcgggcgccttgacacagtgctgctccggccactgctcgaaatcaatgtcgtgcagcaggccgacaatgccccagaattccgggtcataaccgcgctgctccgcaaaacagcgcatgacgccctcaaccgtcagcgcatgccgtaaatggaacggctccgcgttgtacctgcgaagaagctcccatgcttgttgtctggtcattttgcaaaatcccttctgtcattttcaatgtatgcgcagggcgggatgcccatatcagttttgcagccagcttggcttttcccgcattctgacgcctgcggcgatgccgagcgcggcgaacatggtaacgatggacgtaccgccgtaggagaagaacggcagcgtcaggcccatgacaggcagcagaccgacattcataaagatattcataaaggtctggaacagcagcatgccgcctacgccgaccgcaatcagcgccgaaaacggcgtggaggcgcggtacgccacataaaacaggcggatgatcagcgccatcagcaggatgatgatgagcagacagccgaggaagcccagttcctcgccggctaccgagaaaatatagtcggtctggttctccggcacatactgcatctgggtcatcgtgccgttggtccagccttgaccgataaactgccccgagccgatggcgatcttgccgtaggtcgcctgtcgggactgttccacgtcaatggacgggtcaaacagtacgaggattcgcgttttctggtaatccttgagcacataattccacaggatcggcacgcttgcgataccgactccggcagcaatgcccagccacttgagcggcagaccggccgagaacagcatgataaccgcgatcatcaggtactggatcgccatgccggtgtcgcccgacgagagcacgaccgcccccatcattaccagcgtgtgcaagccgaccgaaaccagtccgcgccattcggtgatatgatcctgtatttcggtcatgtgcgcggcaatcgtgaagatgaagatcagcttgccaagctcacccggctgcaggcttgtcacgcccagattgagccatgcacgctgaccgttgacctcggtgccgagcggcgtaaacagcagaaactgcagcagaatattgccgatcacgaatattttccataggtcgcccagattttccaagtcgatcagactgagcgcgacaaacgccgccagaccgagaatgatcgcggcaccctgtacatacaggtttttcgtcgagccgtccagcgccgtcaccggattgagcgttgccgaataaatgaggagcatgccgtagatcgagcagaccagtcccagcagcatcagatacaggtcggtgtttttgatataatgcgtaacagagtgtacaatggaacgagcagtatccatcaaacccctccctttcaaaatggaaaattgagaattgagaattggaaatcagggtatcgccgcaaagcaccgctgctttaattgtgcggtgttgccttaaattgcagtgctttgcactgccacactcattttcattattcattttccattctcaattacatttctatatgataccacaacacacactgctttgcgagtaacaatttcggcaaatttttcgcgtgcttgtatggaaaaccggacgaagtattgatataatgaatatattatgttacccgctgcaaaatagaggaggaatttcatgttatccgatattgaaatcgcacagggctgtcaaatgcgcccgatcaccgaggttgccgctgctgccggtctggatgccgatgatctggagctgtacggcaagtacaaggcaaagctgtccgcagacgtgtggaccaaggtgaaggacaaggaaaacggcaagctggtcctcgttaccgccatcaacccgacgcctgccggtgagggcaagaccacgacctcggtcggtctgggtcaggcactgtgcaaacagggcaaaaacgctattatcgcactgcgtgagccgtctcttggtccggtattcggcatcaagggcggcgcggcaggcggcggctacgcgcaggtcgtgccgatggaggacatcaacctgcactttaccggcgatatgcacgccatcacagcagcaaacaacctgctgtgcgccatgctggacaatcacatgcagcagggcaatctgctgaacattgatccgcgccgtattgtgttcacccgcgtaatggacatgaacgaccgtgctctccgcaacatcaccatcggtctgggcggcaaggtgaacggtgtgccgcgcgaggatcacttcatgatcaccgtagcatccgaggttatggctatcctgtgtctggctgctgatctggacgacctgaaaaagcgtttcggtgatattctggtggcatacagctacaccggcaaaccgatctacgcccgcgacctgcatgcagagggcgccatgacggcactgatgaaggatgccatcaagcccaacctgattcagacgctcgagggcacgccctgtctgatgcacggcggtccgttcgccaatatcgcacacggctgcaacagcgtgcaggcaaccaagctggcactcaaactgggcgatattgccatcacagaggcaggcttcggcgctgacctcggcgcagagaaattcatggacatcaagtgccgcaaggccggtctggctccggactgcatcgtactggttgcaaccgtccgcgcgctcaagtacaacggcggtgtagccaaggctgatctcaaccagccgaacatggatgcgctgaagcacggtatctgcaatctggatgcgcatctggataacatgaagaagttcggcgtaccggtcgttgttgccgtcaacgcattcccgaccgacaccgatgaggagatggatttcatccgcgagcactgtgccgagcgcggtgtgcgcgtagcactctccgaggtatttgccaagggcggcgaaggcggtcaggcgctggctgacgaggttctggctgtgcttgacgagagcaaggccgactttcacatgctgtacgaggattcgctcccgctcgaggacaagatccgcaagatcgccaaggagatttacggtgcactcggcgtgaccatcgcgcctgccgcaaagaaggagctggcaaacatcaccgagatgggctacggcaacctgccggtctgcgttgcaaagacgcagtattcgctctccgatgacgcatcgctgctcggccgcccgaccgagtttgttgtcaacgtgcgcaccgctcgtctggctgccggtgcaggctttgttgttgtagagaccggctcgatcatgaccatgcccggtctgcccaaggttccggctgcagagaagatcgacgtagacagcaacggtaagatcaccggtctgttctaaggcaacaccgcacaattaaagctgcggcggtattgccctaaatacaatccaaacgaaaagtggagagaacaccggctgcggtatgctctccacttttccctcttctttttgctgtgaaagtgatattatgcaaatcagtcttattttagcacagcagattgccgagctgtttctcattcttctgatcggctgcgtgctcgtcaaggcccggctgctcaaaagtgcggacagccgcgtgctgtcggtcgtgatggtgtatgcggttatgccgtgcgtcatcatcaacgcctttcaggtggattactctcctgccgtcgttaccggattgctgtacgcctttgcgctggcgattgcgctgcacgcgctgcttcttctgctggcgcggctgctgcgccgtccgctgcggctggatgtgattgagcgcacctgcatcatctacacgaatgcgggcattctggtcattccgctagtgcgggcactgcttggcgaggattatgtgatctattcctgtgcgttcctcgtcgtacagcaggttctcctgtggacgcactgccgcagtctgctctgcggtacgcgcggctttgcgtggaaaaagatcatcggcaatgtcaatatcatcgccattttgatcggcggtgcactgttcatcctgcggctgccgctgcccggtctggtgaacgatttgttctctcagcttggcgcgatggtcggcccgatcggcatgctgctggccggtatcgtcattgcggacacgccgctccgccagctgtttatgcgccgtcggcattatgttcctgtgctgctgcggctgattatctgcccgattatcacggtgctgctgcttcgcgtcatcggtgcggcaagctggattccggatggacacagcattctgctgaccgtgtatctcgcgtgcatcacgcctgcgtgcgctacggttacttcgatggcgcagctttacgaccgcgatgctgaatattccagtgcactgtatgtgctcacaacgctgttctccatcctcaccatgccgctgatggtatgggtttttgttaatatcccagtttttcgccgatgagcacgacctcacagctttcaaatccactcggcacgcccatatgaatgaccatggcgcggcagatgcgctccgggcttttgcagttgtgacatctgccgtcaaccgcacacggtgtttttttattcagccgcttggcattgagcggagcggcaatatttcttgcccgctcgatggcgctctgcaggtcgggacgcagcttgttcacgccgcacacgaaaatgcagcgcttcggtccgaacagcgtggccgccacgcggttgcacttgccgtcaatgttgacgatctcgccagtctcgctcagtccgttcgctgaagacaggtaaacgtccggcgtctggcagtacacgcccttgtcgatccaatgccagtgcacgtccgtgctgtccgcaaagttctccgggaaaccaagctgcttcatcgtcattgagccgcctatcgacacgtatttgcctgcacaggtgtctctcaggtaggaaaccgcctcgtcttttgtggcaaaatagtggaaaccgaagtcgtagccggtcagagccttctccaccttgctcacatcgggcacgccgtactcgaacagcggcagcagatcgctcggctcatacgcaagcgcgtccgcaccggatgcacgcagctcctccgccgagcggaatccccaggtaacaccgatggcggtcagtcctgcgttcaccgcagtctgcatatcggtcgcactgtcgccgatgtagagggtcgtttccttatcgccgcccagctcgtccagcagctgcagcacgcttgtcggatccggcttgcgcgggatattcgggcgttcgccataggtaatgcttactaaatcaccgaaatagtgctcaatcagcgctttcgcggcggaatcgtacttgttcgacagcacaccgaccgtcacgccgttctccttgagcgtttcgagcaccgaagcaatgccctcatacggatgcgtgcggttcatcatgtgctcgccgtagaacgcgcggaaatccgccagacagatgtcgatcatctcgtccgtgcggctctcctcgggaatgctgcgctcgaccagcttgcgtacgccgttgccgatgcggatgcgcgtctgctccatgctcaccggcggaaagccgtgcttctcgacggcataggttacgctgtcgcacagatcaccgagcgagttgagcagcgtaccatctaaatcaaaaatggcagttgtcattttcatacatattcgtccttttcttgtctgtgaaaatagaataccgcaccacagaatcccgtgatgcggtatcattatagcacattttcttacccgcgcatatacgtcttggtaatttcaccaagcatggacgaaaccgtcgggttgagcgcttccgcgcgcacgcgccagcgccagtttttgccgccgatggtggcaggcgtattcatgcgggaatccgcaccgagcgagagcagatcctgcagggtcgtcatagcgatgttcgccgaggacgcccatacgcacttgatggcactccagcccatggcctcggcgtgcgaggtacgcagatagcggtatgcaaactgcttttccggctcggagcagatgtccatgatctgctcgcacacggtctgcgaatcgtgcgtcgaggtatagacaatgctgttcggcttatagttgtgcggcaggtgctcgttgtcgtaatccggcgtaaagccgaaaatcagcacgcgcatgcccgggaaaccgctttcctcgagcagcttcttgacctcatcggtctgcacaccgagatcctccgcgatgagcggcaccggaccgagcgccttctcgatggcgttaaacagctccatgccgggacccttgcgccacttgccgttgatggcggtctcctcgtccgcgccgacctcccagtaagcggcaaaaccgcgaaaatggtcaagacgtaccacgtcgaacagcgccatgttgctcttcatgcgccagatccaccacgcgtagttttccgccttgtgcgctgcccagttgtacacggggttgccccacagctgaccggttgcagaatagtaatcgggcggtacgcctgccaccagcttggggctgcggtcgggcttcagcttgaacagcttggggtgtgtccatacatcggacgagtcggcggaaacgtaaatcgggatgtcaccgatgatctgaatgcccttttcgttggcatactcgcgcagtgccgtccactgcttgaagaaaatatactgcagaaaaatacggaaatctacctcgtcacgcagctctgcggtcactttttcgagtgctgcagacttgcggtcgcgcacatccttgtccggccacatgtagaccggcatgtgatggtatttctcctccttgagcgccatgaacagcgcgtaatccggcagccattcgctgttcttctcggtgaaggcggcgattttctcgcgcatttccggtgtcacgcggctgtatgccttgcggaacagcggccagcgggtatcggccagctgctcgaaatccgcggtatccggcgaagcatcaaaatcgccctgacgaacctcatccgcagtgagcagaccgtcctccacgagcagatccatgtcgatcagatacggattgcctgccgctgccgaaaagcactggtacggcgaatcgccgaagccggtatgaccgagcggaagcacctgccagtaggtctggtgcgccgccgccagaaaatctacaaaatcacgggcggtcttgcccatggtgcccacgccgtgcggcgaaggcagtgaagtgacgtgcgcaagcacgccgctggaacgcttaaacatatccttctctccctctgtcagtggatctgttgttattatagcacagatgtagcatttaaccaagaactatctgcaaatttgcatattttttgtgaaagttgtggtctttctgtaaatttggctgagataacggttgtgtcatactatatctctgtggtataatattatgtctattattgcagaagatgtgccgcagaccggagtattctgtggcagcttactcttttttcgtcccgtttgaggacagttttccgtactagggcaataccgcacaattgaacaagagcgatttgcgagtaaattttgcgtactgacgaggcgcggttttgcagcaatactgacgtattgcaaaaaatcgcaacaaagtcaggactcaaaatttccgcaaagcgccgcagctttaattgtgcggtgttgccctaaaatactgatgtaaggggtttatcacgcatgagaatgcgcaaaaagaaaaacttggacgttcgatttgccgcctgcgcggacgttatggcgtttgagccgaaggaaaaacgcggcaagtggcgcgccctgttcggcaacgacaatccgatccatctggagatcggctgcggcaagggccgttttgccatcggcatggccgagcagcacccggatgtgaattttatcgcggtcgagcgcgaggaaggtgcgctcatcatggcagccgagcgctgccagcagcagccgctgcccaatctgcggtttgtatccttcgacgcggctgagctgcgcgaggtgttcgcgcccggtgaggtagaccgcatttacctgaatttttccgatccgtggccgcctaatcgtcagcgcaagcgccgcctgacctggcgtgcgtatctggaagtatatgacgaaatcctgcgtcagcagggtgatctgtgctttaagacggataatcagcgctttttcgagtggagtctgcaggagatctgccagtttggctggctgattcagaatatctcgctcgatctgcacaactcggactttgagggcaatgtcatgaccgagtatgaggagaagttctccgcggagggctaccggatttatcgtctggaggcacgccgccgtctgccggaatttctaaaaaagtaaacaaaagaggaaggttttcaccttcctcttttgctttttcaaagttccggttatcagtattgtttgttagtctctgccagacggtggttgagcgcttgcgaagcgaacgaaatcttgcctacccggcaggggcacaagagggtagacaccaaggtttccaccctctgattttcacccctttcctaagatagtctggcgcagaccagagaccagcgaccgcttcgaaaatggggaacggcagaggattttttcttccgtaggggcgcacagagtgcgcccatttctctacctattcgcagtgtcagattccatactgctacacataccatttcatctctgcaagcacgacacaaggtgaattgcccgaagggcaagagaaaccatcgcgtacattttccattctccattcccaattttccattctatacgcataaaaaaagaggaaagcacacgctttcctcttgcccgttacagcttattgtaccctctcggggtgacgattgcatccagcggagtgcctgcggcacagtccgggcaggctttgccgcgcacaaagttctggtaatgcggaaaatccgcgccggagaacaggctaacaacctttttgccgctcagctcgctgatattggagaacagcgccgcaaagccggagacgcggccgccgtaatactcgacgcactccttcgcctgcgagaaggtctgaccggtggatgcggaattgaccagcacaagcacattgcggtgctcgatcatatggcgcaggttatccgagaacacaaactgaccgttgacattgctgtccggctcgacaagatacatatccttgccgctgttgacattgcccatgcccacgctcgacagctcaccggcgagatacgcgccgatgtactccgtgccttccatgcacagcagtgtatcaatgctggtggacgagaactggtatgcaatgctgcgcgcggcttctctggacattgccatgctgtgcttgatctcggacatatcaatatagtagttgatgtgcgaatgattcgtggcaaaatgccccggtatcgcgtccgcgtaaagccgtttgttcacacgggaggtgatgcggatcgactgcttcatacaaaaaccacctttcttacagcgcacccctatcggggaatatctgagaatctgtctatattatacctcagtccggttctcgtggcaagaaaaaaggcgcggcagcagcttctcaaattgcacgccatgcatagggtcggtatgctgcgcggcggtgtaggcgatgcagtccttgacgaactcgccggcgagcgcacaggcatcggcaagcgccctgctgttcagcagtgcgccgagcacgaccgccgcaaacaggtctccggtgccggggtaatactgcgcgatcctctcgtgcagactgatggtgccgccatccgcagacagacagccggagccgaccttccccggctcgtaatccaggccggtcagcacaacctgtgcgccgtagcggctgtgaagtgcatgcagccactcctgcgcttccgtttcgttctgcggtgcggaggccgggtcgcggtcgagcaggatcgccgcttcggtcgtattcggcgtgatgatatccgcaatttcgcacaactcgcgcatacgcgtgcacatttcggatgtataggtagcgtagacctcaccgttatcgcccatcaccgggtctatgaacgccgtgccgttttcggatttcagccgcagcacagcatcccgcacacagtcgatctgatccgctgagccgagaaagcccgcgtacaccgactcaaaccgtaaccctaaccggtcgtactggtcgataacacgcggcataacgccggtcagatcaactgtttcccagccgggaatggccatgtgcgtggaaaaatatgcggtcggcagcggcacgcactggtgtcctgccgccgaaatcgctgcaatgatcggcacaagcgacgaacgtccgaaacccgacagatcgtgcagcgctaaaacctttttctgcatggatttgctctccttcttgctttagggcaacaccgcacaattaaagctgcggcttcttgcgcaggctccggtcacgctgccgcggcgctttgcggaaattttacgccctgtctgtatttcagcatacaatgaaaagccttttctgtcaacgcacctgtctgccagaattcacattatgtacttaaatttcccgatcggttgtggtataatatagggtaacaaattggcgaagctgctttcacaagcagggtatgcaatggttatgaaagcagcttccggataaaaggagattcttcatgctgaaaaaacgcattctatccatcgtgctggcgctgaccatgctgatggtaccgggcgcttacgccgctcagcccgcaaaggacgatatgcacggtgtctgggtcgcgtccgtacataatattgattttccctccgagcagggcatgaccgccgaccagctcaaggccgaggccgataccgagctggacaatattgccgcaatgggcctgaacacggtcttcctgcaggtgcggccttccgcagatgcgctgtatccgtccaagctgttcccgtggagccgctacgtcagcggcacggccggtcaggcaccgaacggcagctttgacgtcctcggctactgggtaaccgcagcgcacgagcgcggtctgcagctgcacgcgtggatcaacccataccgcattacgattgacggcgaggacgaatggaacgcaatcccggattccagtccggccaagcagcacccggagtgggtagtcaaatacaacgataactactacttcgatcccggtattccggcggtgcagcagcttgtcgtagacggtgcggctgagatcgtcaagaattacgacgtagacggcattcatctggatgattatttctatccgggtacggattttgccgatgaagcgacttacgagcgctacggtcaggatttcagcaggatcggtgactggagacgcgacaacgtcaacacactcatcgctgctctggatgagacactgcatacgctggataagaacctctcgttcggtgtcagtcccgccggtatctgggaaaacaagagcgccaactccaagggcagcaacacgcaggggcagtcctcatacagcgagctgtactgcgattccctgcagtggatcaacgccggcacagtagactatatctgtccgcagctgtactggtcgatcggctttgagcctgctgacttccagacgctcgtcaagtggtggcagaaggcggtttccaccagcgatgtagcgctgtacatcggcatcggcgcataccgctcggcggaagcgcagcccggtgatacctggtacggcacggatgaaatcgagcgtcagcttactctgctcgatgacagcattgatattcagggcgaggtatttttcagttatgcctctcttgagtccatcggcggctgtccggccttcctgaccgcgcactacgcggaagataagccggtcaccaagccggataccgacaattccggcaccatcacccaggaggaagcacagcggcaggctaccctgctggatatgctttcccgctttatcgtttccctgttccgctgaccgcacattttttcggaggtgcattcccatggtcgatctactcacccgtgaatatgaggtgaattacagccacattgacaaccgcggcattgccaagccgtccttcctgtggaatatcatgcaggacgcggcgaccgtccacgcagaagcgctgcacatcggtccgctcgatctgcggattgtgtgggtgctctcgcgcatgaaagcgcggctgacacgtccgctgctgccgtatgagcggctgcggtgcgaaacgtggtgtccgggcatcaagggtgcaagctggtaccgcagtttctcgttctttgtggataacaagccggttggcgacgcacagtctatgtgggtaacgctcgacccggagactcaccgcattgtgcgtccgagcgcatttcccgaagccgagcagtacctgcacacctcccgcggagagctgtttgcgccgctgcccaagctgtcgtgtgacaatgtacgcctgcatcatgttcacgaggtccgttattcggatctggatgtcaacaatcacgtcaacaacgtgcgtgcggtcgagctgatctcggacgcgctcgacctgtacaagcagccgggttttgtctccgagctgcaggtcaactacaccgccgaaaccgcctgcggcgaatcgctttcgctgctgaccggtacggcggacagcgcacgttacattcgcggtgaagccgatggcagaacccgcttcgaggcgcttgccacgctttcgccgctgcccgacccgaaggagggattggtatgacgcaagcgatcgagcaggctgtatgcgacattttgggtgcgtgccagccggtcaaaatcatcctgtatgcggaaaagcgtacgatggcaaccgacaagctcaaggcgttcagcctttgcgttatcgtgccggagagcgccaactgccgcacactgcgcacacacctgcacctggcgatcacggtttccgtacccgtcagtctgagcgtttacaccaccgaggaatgggcggagctttgcacggacagtacctcgtatgccgcatggatcgcccggaaaggcaaggtgatttatgaccagacggcgtaaaggtgcatccgacagttgtttttactacaaatggctggacaaggcgctgtgcgacctgcaggccgcacgtctgctgctgacctacggcggcgatcattacaacatcgcgttccactgccagcaggcgattgaaaaggcactgaaaggctatctgctgttccgcaccggacggcattttgacggacacaacctgacgtacctgtgccgtcaggcgatccagctggactcgaaggcgttctccgaatatctggacgagagtgcggcgctcaacgatttatatattgagacgcggtatccaaccgacctgccgtttgagattgatgagctggaggtccgccggtatctggatatggcagagcggatgtttgccgcgattcggcaacagctgtacgaaggcgggagaccgcatgagattgtgcaaagacgataaatctgtcttaaaacgtgaaattttcgcttgcgaagcgaacagaatcttgcctacccggcaggggcacaagagggtagacacctgcggtttccaccctcttgtgaatcacccctttcccttagaaagcacggcgaaattttcagaactgagactataaaggaatggcaaaggattttttctaccgtaggggcggaccaatgtgtccgcccatttctttacctctacgcaatgccagattccttgctgctacacatatcggctactctccgcaggcgcgacacaaagtgaattgcccgaaggacaagagaaggtccccccttgggggatacccgtgccgcgcaactcgtttgtcgggtgctcattgtgcatcccgtcgaattttacgttcattttccattcttcagtctcaattttcaattgggtactcttcactctcaactctccactcttcactctctacaaaactcctacctcctcactcctcactcctgccttgcgtaatctctcccatcttgacacttgcatactccgtcaacttttgctatcatataaggatgtaaggagtgactaaccatgaacgctgcggaacgacgcactaaaatcacccacctgcttgcacaggcgaacgggccgttatcggcgaccgcgctggccgcgcaatgcggtgtcagccgccagattattgtaggcgatgttgcgctgctgcgtgcaggcggattggccgtgctcgctacgccgcgcggatatattctggagaacacctcggcgccggcctgtgcggagcgacacattgtcagccatcacgacaacagccgcatgcttgaggagctatacacggtcgtcgatctcggcggagccgtgattgatgtgacggtcgagcacgctgtatacggtcagatctgtgcaccgctacacattttctcgcggtatgacgccgacgcgtttaacgagaagattcagcagtccggctcccggccgctgtccaacctgaccggcggcatccacctgcacaccatccgcgctacggatgagaaaacgctcgaacgcgtaattcaggggctcaaggacaaaggctttctgctgctcgaggataactaaaaaatcacccgaacgatagatttcgttcgggtggttcagtctatcaataaagtccgttttcgcgatgctgacgctgccgcgcggcagcgcgcatgaaatagaatttgctgtgcaaattcgtaaaaagccggagcatgtatctggctttttacacttctggaggaactttcggacgactttggaacggcctgcggtccgttcctgcttgtcggcgaaactgtagtttcgcgacagccgcaaccacccgaacgacaggtttcgttcgggtggttttcttttactcattttccgcctgctgttccttatacatggcgatctgctccgcatcccagacctccagatcacgcacaccggctcgtccttcaacgtggtggcggaattcatgccgcaggacttttcgcatttcttcggtcagctcgtcctcatccaaatggcggtacgcccgcttgaacgagccgtagtacattacaatatacttgcccatcgccggatcaatgcggtactgccccatcacatacagcgtgccgctgcggtcctccgggtgcagaagatagccgggttccacgacgataccgccgttcagctcctcgtaaaacgactgcggaatctcctccgcaagatcggataaaatttcttcaaatcggtcgatcgagatcatgcctgtcttcctttctgaccttgctgcttgtctgcccttactatatcacaacctgttttttcaggcaaccaaactttttatgaacaatgtgtcttgacaggtgttgtttcatattgtatacttctatctgttcacaaataaagggatcggaaaggaattgtatcacttatgactatgacgaaaaacaagctgtaccacatggtgctggccggtattctttgtgccattggcattgttgtcccgatgtttatgccgcgtatcgtacttggcccgatgtccttcacgctggcaagccacgttgccgtattcctcggcatgttcatctctccggcggttgccgtagcggtctgcatcggcacaaccattggcttcttccttaccacgccggcaatcattgcactgcgtgcggcgtcccatatcgtgttcgcgttcatcggtgcagcctatctcaagcgcaatccggatatcatcaaccgcccggttgcaagcaccgtattcaacttcattattgcactgctgcacgctgccgccgagatgatcatcgttacgccgttctttatgtccggtgcgctgtttacgccggagcagctcgcaaacggctttgttgcaagcgttgttctgctggttggtctcggcacggtcattcactccatgctggactactctatttccatcctggtttggaagccgctgtgcactgcaatgccgcagctgcgtacctcgcaggattaaatcccttaaaagaaaaaccgccgaaatttcggcggtttttttgtgcttacttcacctcgcagccgccccattccacaacggtgaagccgtctctcgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttacttcacctcgcagccgccccattccacaacggtgaagccgtctctcgcaaacggcgtgaatgtctgcggctcgatgttctgcggcctgcccagtggcttccacgccatgaatacgcggagaacgctgtccggtgtcgggtcgatatccagcttggcggcatctgtgtacgcctcggactggaacgaaataaggttgtacgggttatcctgcattttcggcagccagtacacgataaattcgttgtactcgcgcggtgtcaagccgatctcggccagtttttcgcggagaaaatccgccgtgtccgctccggctacgcagaagcccttggagaagtcgtagtcggtgttgttctcgccctcccagaacaggtaggagtattcgtttccgttttcgtcgtacagcgtgccgtccggttcggcggtgacagtccagccgttctcgtaggccggataggtcgcggtgagcgtacccgcgtaatccagcgatacggaaaccgtcgtttcctgctcaggatagaggtagatgacgggtttggcatcgccctgttcctgttgaccgcaggcagtcaagctcagtgccagcatggctgtgagcgttcccgcaaacaatcgtttcatgccgttccctccttacttcacctcgcagccgccccattccacaacggtgaagccgtctctcgcaaacggcgtgaatgtctgcggctcaatggtctgcggcctgcccagtggcttccacgccatgaatacgcggagaacgctgtccggtgtcggatcaatgtccagcttggcggcatctgtgtacgcctcggactggaacgaaataaggttgtacgggttatcctgcattttcggcagccagtacacgatgaactcgttgtactcgcgcggtgtcaagccgatctcggccagtttttcgcggagaaaatccgccgtgtccgctccggcgacgcaaaagcccttggagaagtcatagtcggtgttgttctcgccctcccagaacaggtaggagtattcgtttccgttctcatcgtacagcgtgccgtccggctcggcggtgacgcgccagccgtcctcatacgccggataggtcgcggtgagcgtgcccgcgtaatccagcgatacagaaaccgtcgtttcctgctccggatagaggtagatgacgggtttttcagctgccgactcctgctgtacgcaggcggtcaatccgagtgcaaacgccgctgtgagtgttcctgcaagcaattttttcatagcgattcctcctttgttcggttagacgaaatcagggcggtttggttccctgttctgcggaaatttacggtcgtacccactcaccggtcagctcattcttctgcagaaccagatggaagccgtcggcatcattaaaataaaccgccttatccatatcctcaatcggcaggacaacggtgtatcccgcactcatcgtgtttgcactgccgaatgcattgtaaaacgtaagataatgttcgccgttcttcggctcgtccttataatcccggatatcctcaatcggcggaaagacagctgcatgaagtgtcagcgttttctcattctcggaaaccgtgtaatcgcgcagtgtgacattctgctgctcggtcaatcccgatcccacacgaaacaccagaaatggtacgagaactgcagctaacgcaacaataatctttcgtattttcatcgtctttctcctatcctcttatctgcaaaaatgcgaaaggccgtccgcaagggacgacctttccgcactctctcttttctcttttccctatacagcagttacttcttcaggcgattgatgtactccagaataatatcggaggaatattcaacgcccagacggcctgcgttaatgcagaggtcgtaatggtcgcacttgccccataccttgccggtatagtaattgtaataggtagaacgctgcttatccatcttttcgagagcagcctcgggcgtcttgccctcgatgacgtaatcaccgcaggtctgaacgcgctttacacggtcctcaatcgagccatggatgaagaaatcgaacttattcgggaagtcacgcagtacatggtctgcacagcggccgacgataacacacgaggaatcctctgccatctcgcggatgatattggactgagccagatacagctgatcggtcaggctcataccgttcagaccaaccgaaccgaacatcgtcagcgagtacaggaagctgttggtggcacgcttgtcgagctgctcgaacagcttttcgtcaaatccggtctttttagccgcacgggtaataagttcccggtcatagaacggaacgcccagacggagcgccagcttctgaccgatctcacgaccaccggtaccatattcacgaccaatagtaataatcaagttgctattcataacgcaccctccttaccaaccggaattatacaaattgtacaattctctatatttgtagtatgaaccatttatgcgtttttgtcaagtaggattcaaaatttttttcattctgtaaatttgattggttttcgctttgaagcgaacgggtcttgcctgcccggcaggggcacaaggtgaattgccctcaccccgccgtctatctgatttgcaacattgccaatggacaaatgaaaaaaccgccatgtcaattctccattttccattttcaattctcaatttggcaaaagaaaacccgctcgaaagcgggttttctcgttatctgtttacttattcttaatcagcatcggtccgacttcattgatattaccggcgcccatagtgagcaccagatcattcgagcctgcctccttacggagataatccgcaatctcgtcaaagctgtcgaacgataccgcacccggcacctctctggcgatatccgaagaataaatgccgatggtattcttctcgcgggcggcatagatcggagcaagaaccgcctgatcgcacatcttgagcgcctccacgaactcgtggaacagcgccttagtgcgggtatatgtgtgcggctggaacgcgcaaaggatacggtcgaagtgcatttcctttgcggtgttcagagtggccttcatctcgctcggatgatgcgcataatcgtctacgacggttgcgccgttcggcattttgccgaccagctggaaacggcgggacgaaccggtgaacttgttcagaccgcgctcggcagcgtcactcggcacaccgaggaactcggcagcggcgcagcacgccagtgcgttcagcatgttatggcggcccggaacggacagcgccaccttagcgtacttcttcccctctaccataacggtaaagcggtagtagccgttctcatcgcgcacgtcggtcgggtaaacgtccgaggttgcgctcgtgccgaaggtacggaccttgcggttgatgcctgccacactgcgcattgcatgcgggtcatcgccgttgacgacaacaaggccgttcatcggggtcagctcggcaaactcgtggaacgagtggatgatatcgttgatatccttgaagaagtcgagatgatcctcctctacattgaggataaccgcaacggtcggtgcaaagcgcaggaacgagttgcagtattcgcagctttcagccacaaaacagcccttgccgccgatacggagcgtaccgccgatggcaggcaggttgctgccgaccataacggtcgggtccatctgcgcttccatggtcatgagcgtcatcatcgaggtggaagttgtcttgccgtgcgtgcctgccagacaaaccacgttgtcatagtcgcgcatgaggtgtccccatgcctcggcacgctccatgaccggaatgcccagctcatgggcgcggacgatctccggattgtcatcatgcacggcagcggtacgcacgatgagcgacgcaccctcaacgttctccggcttgtgctcgtaggtaatctttgcgcccagagcctccagccgcgcggtaacatccgtacgcagacggtcggagccggaaatcggcacaccgcggctgagcagcagctcgccgagcgaattcatggacacgccgccgatgccgatcaggtggatgcgttccttattttcaatgtagggcttaatagacagagccatttccctaagcctcctgtattttcgtttattagatttattatagtacaaaatcgcccggaataaaatagctaaccgagaaaaactcctgccggacctgaaaaaaaggaatatatgataccggaaataccgctgcatatcgcttatccgcatacatttaactaaagtgtagtttgattttttcgcatgtttacgataaaatattcttaggcatgctgtcctgtccggtcagcacaaatgccgcaatataaggagaggcattgtatgagagtactgattttatccgtcaccgccggtttcggtcaccatgccaccgcaaaggccatcggcgacatgctggaatccaagggcgcggaagttcacacgctggatgtttacgcctatatcagcaacctgatcaaaaccaccatcgacaagggctatctgttctcctccaagcacatgcagacgctgtaccgtctggtctaccagctggccgagaacaacggcgcaagctattttaactctgcgccaagcattatcaatatcatcaacgcactcggtgcgtccaagtttgccaaggtcattgcgaaccatgtgcccgatgttatcatctgtacgcacgtttttgcagcgcagatggtcgatgaactgaaaaagcgcaaaaaactcgccgatatcgagaccatcggcattgttaccgactacacgctccacccgtactgggaggatgtgccgcgcgtgcagtacatcgtcaccgcgagtgaactgctcacctaccgctgtgtacagcgcggcattccggaggaccgcatcctgccgttcggcattccggtgcacccgaaattcaacgaaaagctgtcccgcgaggacgcggcggcacagctcggcattgacccgaaaatgaaaaccatcctgctgatgggcggcagcatgggccacgccgaccatgtgaagaacatcgaaagcctgtcgcagatcggcacgccgttccagtttcttgtggtatgcggcaacaacaaaaagatgctctaccatgtagagcagtttgccgcgcattatcagggcagctgcaggatctatccctacggctttgtacacaacgtagaggtgatgatgagcgcgtccgactgcattgtatccaagccgggcggtcttaccgtgtccgaggctctggcgaaaaacctgccgatgctgctgttcgatccgatccccggtcatgaggagcgcaatgttgattttctggtcaacaacggcatggcggcgctcattaccaagcacttcccgatcgacgaggcggtgtacgagctgttctgcaatccggtgcggctggagaccgtgcggagaaccatgagtgagattgcccatccggatgccaccgagcggctggctgaatttgtcctgcgtaaacgataataccgtgaaaaggagtacccgcaggcgggtactccctttcgtgccgttaaattcctactgatttactcagttctgcgctgcatccgactgcggcaccagcggtgtcagcagtttagtgatcaggctgaccatctcggtcttcgggatgggctgcgactcggtgatccacttttcggtcataccgatgacaccggtcgcaagaaagcgtgcagcatacgcatcctcgacactgcggtacggcagcagctccatgcggcattcctcgataacgccgatcatcttttttccgaaaccatccggcgcattgaccttgatgagtgcggtgacgatctcacgattctcctccagataatccatcagacggctgagcaccagcttgagcgttaccgtctcactcggacggatggctgcgatcatcccgcggaaatcctcgatcatccctgtctcgatcttatcgcgcaggtcatacacatcccgataatgcgcataaaatgtgccgcggttgatatccgcttcgcgcactacgtcggtcacggtgatgctctggaagtccttctgctgcatcagccgcgtcagtgcctgccgcagcagctttttcgttcgtcggatgcgcttatcctccacttctgccatggtatcccactccattcatatttttttccgtttcatttccgtaatttgcattttaacgaacatatataatatttatgtgcattatcattcgctcttatcacatttgattattgcgttcgttatccttatgtactatactatatcacgaaaaaaaatcctacacaatatctatttctgagaaagatggtgttttctttgtgaaacttaaaggacatagccctgttgacctgatcattaacaatcgaaaactgattgaaaagatttatatcgtactggtcatcttcagtttgatctgtgtgccgatggttgggatcaactacgatttaacaaaatacctgccggattcgtctccgtccgcacaggcgctggacattatggaggacgaatttacctatcccggcatgggccgcgtcatgctcgaggatgtgacgctgtacgaagccaaaaacataaaggaccgtattgcggacgttgacggcgtggatatggtcatgtggtgcgatatggccaccaatatctacggctcgagcgaattcatcaactacgacaatatcgacgactactacaaggataacaccgcctatatggatgttatcttcaccgacaaggactcgtccaaccagacccacaaggcggtgcatgagattgaaaacatcgtcggtgacaaaggtctggtagcaggctccgctgtatcagataccaacctcggcccgaccattaacaaagaggtcgcccgtgttatggcactggccgtcgtcattatttacatcattctgacgatcacgaccacctcgtggtttgagccggtgctgttcctgtccgtgctcggcattgcaatcctcatcaacatgggcacgaacatcatcttcggcgagatttcgttcctgtccaacgccgttggtgcggtgctgcagctggcctgctcgatggactactccatcttcctgctgcacgccttcacgcaggagcgcgcaaccggtgcagaacccgaacaggcgatggcgaacgcctggcgaaccgccttttcgtccatcggcgcttccggcatgacgaccatcgtcggctttgccgccatggcgctgatgaacttcggcatcggcccggatatgggcttcgtgctggcaaagggtatcgcgctcagtctgctgaccgtgctgctgctcatgccggcgctcatcctgcgttcgcagaacatcattgccaagacgcagcaccgtccgtttatccctaaacagggccgcggcatcggtgaatttgcgtacaaaatccgtcgcatcgtatttcttgtggttcttatcatcatcattccgtgctacattgcacagggtatggcgaatttctcttacggcaacgaggccgttgcaaactcacccggtacaccggtttacgaggccgagcagcagatgaatgccaagttcggcaagagcaacatgatgatcgcgcttgtcccgcccgacagtaacatcaccgagaaaaagatgaccgaggagatcgacgacctgtcctatgtcaagtacgcgctcagcctgtcgtccgttctgccggaaggcattcccgaggatttcctgccggagaacatcaccagcctgatgcactcgaaaaactgggcacgcgtgatcatcaacgtgcgttccgccggtgaaagtgacgatgccttccaattctcggacaacatccgcgcgatcattgacaagtattacccgaacgaaacgacctaccttgtcggcgtaacgccgtccacgcaggatattaaggatattattgtaccggactacaaccgcgtcaacatcgtttccctgctgggtgtagcactcgttatcgcgatcacctacaaggcactgatcctgccgattgtcgtactcatcccgatcgagtgcgcgatcttcatcaacaccgctctgccgtacatttacggtcagcgaaccatgtacctcggctttatcatcgtcggctgtatccagctgggcgcgacggttgactattcaatattgatgaccggcaactatctggatgcccgctcacaaggggataaaaaggaagccgcaatacgggcggtatcggtcagcgccgaatcggttatgacctccggcctgatcgttatgacggttgcctacggtctgtacttcatgacctcggtcgaagcgatttccggtctgggccagctgatcggccgcggtgcgctgatctcggtcattctcgtactgttcttcctgccgatgtgcctgatgctgttcgaccgctggatcgtcaagtcggattacgcagaaaagaaacacgccaagatgaacaagatccgcgcgaccaagatcaagctgccgatcctgagcgaactgcaccagcagcgcgtcaacctgcagaaccagatccgcgaaaaccgcaaggcacgcaacaaggagctgcgcctcaagctcaagaacctgatgaacggcgatggcttcaagctgccgcagaactacacgccgccgacgcagaagccgtccaaacagcagcagaccgaagaatccgcacacaagcgcatgatcggcaaaaagctgcgtatgcgtatccataaccgcattgagatgcgtaaggagcagcttgaacagctggcccagcgtttcggcagcgacaagaataagccgaacgacagccagaatgacaaccagaacgataatacggaggagaacgaccatgaaaacaaataagctgcgccgactgaccgcagcctcgcttgttcttgcgttcacgctgccgcaggcggcacaggccgccgcgcccacggtagaaaccgacgaatcggtatatatcaacatggattactacggtgcgccgaccaatacgcgcatcgtaaagggtgtcagcctgaacggccacaccgagttcaccgatttcggcagctacgcagatgtgtacaacatgagcacctacgacgagccggtcatcaaagacaattcggtgtactggaagctgtctgacaccagcaagcagcgcttctactacgagtgcatcccgaccgacaaggtcaatatccaaatgccgtggaactttgatgtttcctacaagctgaacggtgtttcggtcaaggcggaggactgtgcaggcgcaaacggtctggtggagatcaccattcacgcggtgccgaacagctacgcaagcgactactacaaaaacaatatgatgctcgtctgcggcaccggtatcgacatgagcaaggcgctttccattgatgcaccgggtgcacaggttcagtccgtgggaacctacaagctggtcgtattcatgggtatgccgggcgaggaaagcacgttcaccgtgcgtatcggctcggataactttgagaacatgggtatgttcatgtttatgacgccggctactctgtcctcgctggatatcatctctgacctgaaggacgtcaaggaccgcctgagcaattccagcgacagcctgtactccggcatgagcagcatgctcgacaccatgcagtccatgcagaacggcatgggtacgatgtcgagcggtatttcgggcatcaacgccgtgcgccagcagctgatcaaggaccgcggcaccattgatcccaagacggatgccgcgctgaccgctctggaaaagctgaccggcgaaagcgattcgctgattccggagctgaacaacaccaaggacacgctcgttaagctgaacgcgactacgaacagcattctcaatacgctcgaggagtccggtaaagatatcaccgagtaccagacgctgctgcagaatatccgtacctcgctgaataatctcgaggatctcatggataatctggatgataagaccggttcggagtggctgtatatcgacagcctgaagaaaaatatctccgatatgcaaaaagacctcaaggcactgcgcaacgatttggatgacctcagcgaccctgtcggcagtatttcgtccgatgttgtgtctgcaatcagtaatgtacaggatgtactgaaagacctgaacggctacggcctcatttccgatgaccgctataacagtattaacggcacactgaacaccatgaagaataacagctctaatctcggtgattctttgcaggatgtgagcagcgatttgtccagcctgagcggctcccttaacaatttcctgggaaccaccagtgatgtgctcgacaatctggacgacatctgcgacattctagacgattacaagggtctgggacaggacttcaccgccgagggcaaaaagctgaccgaactcgccaacaccacactcggccgcgtcaaccagcagctgaccgagattccggcactgaccgagtcgctcaaccagctgacctcgatcacctcgtcctccatcgacaagggcaccgagctgatcggcaccactaccaaaacgctcaccgcgtcctaccagctgctcgacacggtcaacagcacactgcgttcggttcgcagcgacgcggatgccagcacacagaccacgctcgacggcctgctcgatgtgcttgataaggcttcccgctcgaacagctcgaataagctgcagaacgcgaccgatgatattcataatgccatcgacgacgctaagaccgaccttgaggacgatactaacatcctcaatatcgactcctcggccgacctgcagtctgtcacgagcagtatgaacccgacaccgagcagtctgcagttcatcctgcgcacgcaggaaatttcgaccgacgatgacgatgatgctatcacctcggatcaggatgctgccgacgaaggcgttctcgcgcgtattgtgaatatcttcaagaagctcgcaagcgcgatttacggcgtatttgcttcggaagagtaaccgcatatagaccaaaggacaggaaaatttcctgtccttttttcttatccacaggttggggataattacgtaaccgtatggtgtgaaaccgtttgtcaaattcatttatatcatcgatgttgattggtgcaattcaagtagaagcagcggggtgaggtccccccccgccgttccacagagaattacacgataacaaatcaaaattcgcataaaaaaaaacggttccgtctccggaaccgtttttcctatccatttatcatgcgcgaatcttctcgcccatctccgcgcttgcgtgactgagcaccggaagcagcaccgcaccaacgataatgcccgcaatgccctgcacgatattcatcggcacgccgagaacaaccgcggctgccgcagcgcccatgctgctgcccatcacgacttccatgccgacctcatacacaaagtagcccagaaccataatgatctctgccggaatgccgcacagaatcacacgggtaatcgtattcatgcccttgcctgccatgcggtgatacagccagccgccgagcagagcggtcagcgccttgatagcaaacgtaccgggcacccatgccatgtagccgccgataagatccgccatcatcgagccgataccggctgccagggcacccagaccgggaccgagcagaatgccgcagatcagcaccatgccgtcaccgagatgaatgtaaccctgtgtcggtgtcggaatgcggatgatcatcgtagcaactgccgtcagtgccgccagcagtgctgccagcacaagctttctgatgttttttcctgtcatatcgcataccctcttttccagtaattctgtctgtaagcctattgtatgcgatattgtggctttaggaaagtgtcagttcacgcaagtttcacaaggtcagtttcaggcattcgccttgaaattattgatgtagtaatcgccgttttcgtcgtccatcacaacgcagactaacttgcccttggagacaaccttggcctcatcaacgcctacgcagatccacttgcgcgggtcaaccgtggtcttgagcttagccgccgcgtctgcggcctgcttttcatccgcaaagcgcagaacaacgatggaatgtgcctgcgaggtaatcatagactcggaggccacgcctgcctcaaacttgatgtcatccgtaccaaggtaccagaacaggccgcggctcatgccgtcctcacccatgccgttgtagagtgcctcctcggcaacgcccatgccgccgaacggacgcgcaccgtaaatcttgctcaccagtgcagaaagctgctcgtccaccttgacggtctccggctgctccggctcggtcacctccggctttttatagccccagacagcctcgccgtacttcttcataaacaggtcgtaattctcgttgtagcgcttcttatacacgctttcgatctgcgggtcgaaggtgtaagccgtgccgtcgatagtaatctcggtccacgcgtgaaccgactcactgcccttgggcgaaacgccggtgcccggaatcgcctgtgcatcaaagccgacctgacgggcgaggtaagtaaagcctgccgcccacgagtagcagttgcccttgtgggtcttaagcatatcggtcgcagaggtcagcgcccagtcgctcttcgaagtgtcagccgcgccgatgccgaggtaaccgaacgtattcttcgcgtaatcatacaccgcacgcagcttctgctgctgggtcatgctgtccttgacaacgctctttactgccgaagccagcagcgcgtccagttcggtcgagccggtgatgtaatagccgttgtggtcaagctcgagcgagccgatgaacttgtcatggtcaaactgcttgtcctcgttgacatggaacagcttgccgccaatattatgccagcccggcgtcaaatcagtagtctccttatcaaacgaagtccacttttcggagccgctcgacttgtcaaacttatggtcggtggttgcctcaagcatatcccagtatgcccagtgcgtgttcggcacatccggcataatacggatgccctcactcgtattgatcgtaaactcatccgcctgacggccgagcacacggttgaggatggttaccgtctccgcacgggtaatcggcgcattcgggcggaaattcgtgcctgccgaaatccagccctgtgccagagcggtctgcaccgcgttgtacgcccagttggtcttgggtacatcagcgaacgacttgtccgtgccgatgtcggtgtgcgggaagcgcgacagaatcgctacaaactccgcacgggtaatcttagcgttcggcttgaacgtgccgtccgtgtaaccgttcaccagaccgaaattaatcatctgacagacggcattcgcataccacgcggaaaccgaaacatcgctaaacagataatccctatgctcaccccagtccactagcagggacgtgagcaacttgctcgcctctgcacgagtgatggacgcatccggacggaaggtgccgtccgtgtagccgttcatatactgcatatgctctgcggtattcagctgcggctgcggcgccgaattctgagccgcgcacgcggaaaccggcaggactgccgccatgagtgccgcaagcatacctgcggtcattcgctttttcatcatactttcatactctccttcagatcgttttcggggatagtattgaattagacggaatcactcgtcatttggttccctgttttgctcatcttttttacttttttctttttcgggatcgagcacgaccggaatgagcgctgccgccagcttgcccttgccgcggtgcttgacgtagaaaaagccgatgatggaaaacgcgattgcaccgatgcagttgacctgcagatccttcatcgtgtcgatcaggccaatatccagatagccgccaagctgctccgtccaatcctcaccgttgacaatgaccgactcaatctgcacatgcaccggcacattcaggccgtccgggttgagcgacaccgagttgacctcgtgcacgacatagtccttctgcatgtccgtgtgcatcacctgatcagcggtgaactcgaaaaattcccacaacacgccgaccgtcatggagaagcagaacgccacgatagccaggaacagcggcgacagcttgaaggtaaaccgttcgcttcggttaaacaggtcaaccaggcagaagccgaccgccgcgaccagaaatccgtttatcgtgtgcagcatggtgtcccatccgggaatgatggtgtagaacgaattgatctcgcccatgatctcggcggcatagataaagcagtagatgatagcttccatcatcggcgggatgtcgatggcaagctgtttttcaatcagcgtcggcatcgccagcagcacgagcgacagcacgcatacgaacatattctcataccgctgcatgaacgcacagcgtatgaatgtcagcacgaccagaagcgacagtacgccgcgaatggtcagtctgcggcgtacgcggcggcgctgctccgtgacacgctgctgtaattgttttttatccatatttgttaactccttgaagtaatcgcgaaaagggtaaaagagagaacaacgtgtttcgttgttctctccatagtttgtgtattgcttacaggacataaacctgcgtggtctcgtacacctcgtaaaccttcttgagcgaggccatctcggtgccggccagacgggcacatgcacggcccatcgcaacggcgtagcgtgccacctcgtcaaacttcatgcccgcgtgcatagcgtttgcaatcgcgccgaccattgcatcaccggtaccgaccgcaccttcgtcgtagattttcggggtggtagtaacgtatagcgactccggctcgttctttgcggtcagcagagcgccctcctgacccatggaaacacaaacagcctttgcgcccatatccagcatcttgcgtgcggaatgtacaacgacctcgggatcggcggacggcttgtcgccgacagcctcagccagctcgaagatgttcggctttacaaagtccggctcgcaccccagtgcctcctgcagcagctcgccctgtgcgtcgatgatcagcttgcagccgtgcttcttgatggtcttgcacagcttacggtagttcttcagcgggaactccggcggcgtagaacccgacagaacgaagatattgccctcgtccagatagttctccatgcggtcgagcaaacgcaggaaatccgaatcatccagcttgttgcccggctcatttacctcggtgtggccgccctgcgcatcaatgatctgcgtattgacacggagttgtcccgcaatatcaacaaaatcgtggtgaatgtccgctgctgtcagcatgtccttcataatgcggccgtttgtgcccgcactgaagccaagcgcaatactgctgccgcccaacgccttgatcgcgcgcgacacgttgatgcccttgccgcccggttccagatgactggacaccgcgcgattgagcttgcccacctgcagcgggtgctcgatccgctgcgtacggtccagtgcagcgttaagcgttatcgtgataatcatgggacgcccctcctgaaataaaatttccctcatcgcggctccgcatttgtcccgtgcgaataaccgcgttcttctctaatatatattttacaaaatccggtccataatgtaaatggtttttcttgatgttagccgcatttaaccgggttgtttttgtacccaaactttatttgatccagccgcagtcactgcaccacggacactcccactgtttgcccgtgacttttgcttccgcgccgcacatcggacagcgcattttgccggttttcggcaccggcggctctttcggcggttcctgctgccgacggtacagccgcacaaaaaagactgcgccgagcagcagcactacggcgatcgccgcaatctgttctttcgtcatgctgtttctcgtttcacttgtggtacttgccgcctgccgcgatattgagcgcacggtaaatctgctcgagcaccatcactcttgctaaatgatgcggaaacgtcatcggtgacatggacagccgcagcgccgctttctttttcacccgctcggacaggccgcacgagccgccgatgagcacgcagatcttgcttgtccccgatacagtcagctttccgaaatagtccgccagctgctcagaggacatcggcttgccttcgacacacatcgcaatcacagacgcgccgggcagcagcttgctctcgatgagcgcggcttccttttcgagcgcctgcgcgatttcgccctcagagggcgtctgcggcagacgctgctcgggcagctcgatgatctctaatttacaatatgcgccgaggcgcttggtatattccttaacagcgtccgcccagaacttttctccgagctttccgacgcagatcagccggacagagagcatagtttttcctccccaaacgataccggatgctccatgtgctcctttggtgcaacgagcacctcgcacgcaggcagtccgcgcagcgccgacagcgtttgctgccgcgccagctccggcatgttgtttttctcactcaggtgcgccagcacgagcgttcgcgtgccgtttttcaccagatccgctgcaaatacggcgcagtccggattggacaggtgcccgctcggtccggcaacacgcatcttgagcgaatacgggtacggaccggcctgcagcatgtgcgggtcatggttgctctccaacacgaccatttcacagccgcgcagaagctcggccgcatcgcgcggcacaaagccaaggtcggtcgcaaagccgaaccggctgccgccgtgctcgaatatgtagcccgtgctctcggctgcgtcatgcggcgtcggaaacggcacaacgtccacatccctgacccagaagcgctcaccgctgtcgaatatgttcagacggtcggcgtactccggattcttttcctcgaaagcctcggctgtgccgcgagtggcaaacaccggcgccttcgcttttttaagaaacatcggcagtcccttcacatggtcgatgtgctcatgcgtcagcaccaccgccgaaatatcctccagcgtgagcgacagtgccttcagcgcagtcgtaatcctgcgcagcgacacaccgagatcgatcaggatcgcggtgccgtccgccatatataagccgcagttgccgctcgaaccgctggcgatactgtaataataatgctctgccatggtactccttcagcagttgttttcatccgtttgtgtgctgcagaaaggcggttcgcgttagaatcatcggtgtgacgtttccgcagtagaatgcgaacggttccccggcaatctctgcgccgaatccggtaagaatgtgcaccgttgcgtctctcgcttcgaggaaaatgttatccacatcctgtgcaaaaacatcgtccagcacacgtttcagcagaaaggttcccttgtgctgtccgcgcagcctgcgcgcaaccgtgatgcggcccatgtgccactgcccaccctcacggtaaatggccgctgtgccaacgagttcgccgtcctgctccatgcaccaccactgcggctgcttatccgccgggatgaagttcagctccttcggaatatcctgctcgtccgcgaaaatctgcgcggcaaaagcgagaaccgcatccatgtccgcatcagacgcacgccgaaccatacactctgcttgcattctgctcatctgccttatattctgcaaaaaaggcgaaaggatgctccctccgccttttttcctcattacaattagaaattacttgttctcggcgctttccggaatctcggagcgatacatatccgcacccagagcaacaaacttctctacgagcgtctcatagccgcgctcgatgttctgcacctgctcgacctcggtaacacccttggctgccagaccggcgataaccatcgccgcgcctgcacgcaggtcgtgtgcacggaccggagcaccattcaactccctgacaccctcaacaaccgcgatcgcgccatccacatgaatgttcgcacccatgcgggtcagctcctcggtatagcggtagcggctgccccagatcccttcggtgatgatgctggtgccctctgccagacacagcgccgtcgtcatctgcggctgcatatcggtcgggaagcccgggtacggcagggtcttgatgttggtcttggtcagcttgccctcgcggcgaacgagcaccgcatcgtcaaactcggtgacctcaacgctcatctcacgcagctttgcggtgatgcactccagatgacgcggaataacattcttcaccagaaccgaaccgccgcaggctgcaacggctgccatgaaggtgcccgcctcgatctgatccggaatgatggaataactgccgccgtgcaggctctctacaccgcggatcttgatcacatcggtgccggcgcccttaacatccgcgcccattgcattcaggaagttcgccagatcgacaatgtgcggctccttcgcgcagttctccataatcgtctgacccttggccagaacggctgcgagcatgatgttcatggtcgcgccgaccgtaacaacgtcaaaataaatatgtgcgccgtgcaggccgtcctcgggtgcctcgacccggatgtaaccgcccttgggcagcgttacctttgcgcccagagcttcaaaacccttgatgtgctggtcaatcggacggacgccgccgaagttgcagccgcccggcattgctacctcggcaaagccgtacttgccgagcagcacgccgagcagatagtaggatgcgcgcagcttgcgctccagctcgtgcggcttgagactcgggttctgcgtattctggatttccaccgtagtggcgttgatctggcggatctgcgcgcccagctcacgcatgatctccatctgcagcgttacatcaatgatcttgggcacgttttcaagacgaaccgggccatctgccagcagagccgccggaacgattgcgaccgctgcattctttgcgccggagatggtcacctcaccattcagcgtcttgccgccgttgattacatactttgtcaatctacctactcctcactaagccttggcgcggaaatctccgcgtttttctccgaatactgtatcttatgtcagcgaatgactgtccgtgccgatcctctttacaggcagctccgacagcggctaaacccattcgcgtaaaatctcactaatacattttaccacaatttcagataaagaaaagcagtttttcagttttcttcaccgataatcgtctttttgtcacaatccaccaaatattcgcctgtttcggtgtcaatcttccaagtaggtgtaagacgaatacggcggctgctgtcggtttgcatacgataaccggccgtcatcgactcgatcgtaccggtttcgccgctttctgcggcaaactgcagcagagcatctgctgcgctgcaggtaatgctgatgccgttcgcggtggtgtacggcgtgccgaagctccacagtccgacgagcgacaccgagccgtctccggcagaaaagtccagtgtcagccgccgattgtgcaccggcagtccggcgaccgagccggtcagcgtaactaccgtgtcctccgccgtccagccggcctgctcggcctgaaagccccaccggctgcacagtcggcgcgcctgctcgagcgcttccgatgcggaagtcggcgcagattcagtcagcgtatagtccgcctgcacattgccgtccgcctgccactcgagcgtgcccctgtcgctctcaaagcgcaccgtgccatcctcctgctcggtgcgttcagcgtgttcgcccagcatggcggctgcgattttttcctcatctgcacggctgcggtcgagcgacagctcgggcagcgtgatgtcctccggaaacgagaacgccgtatccagctgcatccctctggcgctcaccagcgtgcgcagattggcctcaagctcactcgttctccggtggctttgccagccgcgtaccgccagattgcccagcagaaacaggttgatcgtaagcagtattgcgatcagtatatttttgactttatcccattgcaagcgctctcatctcccttctgcggtcactctgccgcatttttcagatagaaccggctcggtacatactgtccgtcctgtgcccggtaggctgccatcagaccgcgttccgcgccggaggctccggctgccgcctgttttgcgggcatgaccgtgcgtttgccgccggtcggctgaaatttctgcagccgaatcgttgccgtgcgcagcgcactgccatcgaatacgaaggttgcaaagtccgcgtcaccaagcaccggcacgccgctgtacatctgcagaaaaatcagtgtggtttgctcgccgctgcgctccaccgcgtacagcgacgcatgcgtatccgtatcgcccgctcgctgcgccgcatcaagaatcagccgggcgcagtccagctgtgcatccagcgccgccgcatccgtgatatcgctttcgtcataagcgctcaccgttgccgagccgtccgtggacgcgtactgcaccagaccggacgcattcagccgcagcgtgctcgtatcatcgaggaacacgcggacagttccgtcctgctcgttgtaaaaatccgtgtaggccgtgtagccgaatgcaccgagcaaatcctccagtccggtgccgctctgtgcggcaaacaggttgatctgcgccggtttcagcaccggaagcgacagcgcctcgctgtcgaacagcagcgtttccggatagaccgcatacgcatctcccgcaaagctgcatgacagaccgcggaagttcttctgtgcctctccaagcgcattctgcgagaccgctgcatccgcagcatacagcctgccgtctgccatacggacaaacagccgctgcacaccggcggcatacaccagcgtttcgacctgcagtcgggcattatccttccacgagccgcccagccagcccgcaatagactgcatcgggatcgcaccatggtagcgcagcagcgcacagctgcccgaccgcagagccgtgcacagctcactctcatcagccggccgcagcccctcacctgtgagcgcctgcgaccacagcgaacgcgttgccgtgatgccggcgtcaatatcggtcagattgtactgcacgccgtacagcttgccgtcaacggtcagcgccatctgtgccggatccgccgccgaaacaccggaggaccgtatctcatagcccaccgcaccgcctacaaagcggtcgtgcagacggcggagtgcgctgtctgcgggcatttgcgcaatgttcagacccatcagccagtttaccgcgcacagcacgcccatcagtccgcacagcaccaaaagcgagatattctttgcggtgttcttcgctgagcgtttcgcacctctcataccttatcctccctgccgtgcggcttgaggtcggtcggaagcgtgatcgtcacggtcgtgcccttgccgtattcactggtcagagcgatcttgccctcgtgctgctcaacgatctccttggcgatcgccagacccagtccggtgccgcctgcggcacgcgagcgtgccttgtccacgcggtagaatcgctcaaacaggcgcggcacatcgtccgccggaatgccgacaccgttgtcctcaactgtgatgcgcacatggtttgcgcctgcgcgctgtgccgccagacggatcctgccgcccgaaggcgtgtacttgaccgcgttggacagaatatttaccacaacctgctcgatgcgttccctgtcgccgaccatcgacggcaggttcggctcggtctcaacgagaatcatgtgaccgctgtcctcggcggtcagcttcatggcattcgtcacctttttcagcagatcggacaccgagaaccgcgtcatacgcagctccatccgtccgtaatccaacttggaaagcgtcagcagatcggtgacaatacgcgccatgcgctcgctctcgctcgaaataacgcccagaaactgcttttccgtgtcaagcggcagctctccggcggcatcgagcagcgtttcggtgtacgagcggatattcgtcagcggcgtgcgcagctcgtgcgacacgtttgccacaaactcgcggcgtgcgtcatccagacggcgctgctcggtgacatcgtgaatgacggcgatgacgccgccctcgccgtccagtgcgccgtaaggcgccagcgtgacggacagcacgcgcccaaatcgcgtaatctcgttcgtaaggaagctgcgcgagacggtttcgtccgtatccggcatgtccagatcggcgaacatctcatcaaagctcagcttctgctctacacgcacgcccagcagattttcggttgccggattcatgtggatgagcgtgccgtcagtcgtaaaggcggctacgccgtcggtcatgtgcaggaacagcgtgttcagcttgtcgcgctcgccctgcacctcgccgaccgtgtttttcaaacggtgcgccatgtaattgaacgaacgggtcagctcgccgatctcatccgacgactgcacaccgaggtcctgatcaaagttgccttccgcgatcgaccgcgccccctcggtgatgcgctcgatcggcgtggtgatggtcttgctgagcaggaaggacagcaggatagccgccagcaggccgaacatcatcgcctgcatgacaatctggaagaaccgccacgacagatcggaaatctcccgcttgttgtccgcaatatacacgatgtagtccaccgcaccgtcgccgttcttgtcgagcggcaccgcaatgtccataatgctgtcggataccgccgagcgcgttccggtctctcctgccattgcggcaatgacgttgctcgtgcgggtgacagatacgttcgggttggagccgtcaaggaagccgccctcactgtcgagaatggcatagttgcggtaatcgtcaatgccgagtcggctcttgtgggcatctatgatggttttcagaccatccgtgccgggttcggcagccgcctcctgcatggagcggatggtgtcggtcgtgaacaccgcctgcatctgctcataaaagctgttcagatagaaggtgttgatactgttgatcagaaacgtgccgaccaccgccataacggatacgatcagcagcaccagaatcagcaccagttttctgtgtagtgaacggaacatagcttactccccgtcagcaaagtaatatcccatgcctctttttgtgatgatgtatctgggacttgccggttcatcctcgattttctcgcgcagacggcgaatcgccacatccaccgcacgcaggtcgccgtagtagtcatagccccagacctgctccatcagctcctcacgggagaaaacccgtcccggagcagcggacagaaagcacagaatatcaaattcccgcgcggaaagctcgagcggatgaccgtttttgtataccatgccgttgtccttggacacacgcagcccgccgccggacggcgcttccgccttttccctgtcctctcctgcgtaggtacggcgcatgttcgccttgacgcgcgccatcagctcacgcatggagaacggcttggtgatatagtcgtctgcacccaactcgagacccatgaccttgtcggtctcttcctcacgggcggtcagcatgatgatcggcgtgtccttttccgcgcgcacccgcctgcagacctcgaagccgtccatctcgggcagcatcacgtccagcagaatcaggtcaggcgcttcctcaagcgcgcagcgcagaccttccgcgccgtcatacgccgcgagtgtgtcgtagccctcacgctgtaaattgaataccagaatgtctgaaatggccttttcgtcctcaaccacaaggatttttttcttatccaaaccctttcctcctctgcactctccaatctccactcttatcttagtaaagatttttcagctttgctctatacatagccgccaccgtttttgcatcgcggatctcgtcccgctcgatcattttctctacctctgcgatcggcagtcgcacgacctcgacaaattcgtcctcatccggctgcatttcgccttcggtcaggtcaagcgcggcaaacagataggtcacctcggtcagaaagccgggagacggataaatcgcgccgagcggcacgatgcgtccggcagtacagccggtttcttctttcagctcgcggatgccgcattcctcggcgtcctccgggccgtggtccatcttgccggcgggcatttcgagcagctcggtatcgaacgcataacggaactgccgcacgaggataacgttgccatccttgtcgatcggcagcacaccgacaccgccaacatgctcacagacctcgcgcggcgcggttttgccgttcggcagcgatacctcgtccacacgagcggtcatgatcctgcctctgaacttatattcgctggaaagctgtttttctgtcatatccatagaaaaaaatcctccttaatcagctgcatttacacagcgcaggatataggcggtctccggcgggacggatacgatcagaccgtccgggtcggcgtacgcgaagccctcaccgctgagcaggtcgagcgcatacagcgcatcaatttttgtttccgcatactggtgtccgcggttgaccacgatcaccagacgcgagtctccgctcgtgcgctcgtatcgcagcagtgcaccggctgtcgtgtcgctgaactgcaggtcgccgtccgcgagcgtctgctcctcggcacggatttcgcacagcttgcggtagaacgcaagcagctcctggttttcatgtccccacgggtaggtccggcggttgaacgggtcctcgaagccctgctgaccggcctcatcaccgtagtaaatggtcggcgaacccggcatggtgaactggatgaccgccgccatccgcaggcggcgcagcgcaacctccagacggtccggcggcagctgatagtgtgcgcggccgtttctgtccattttccactcgttctcggttacgccgaaaagggtgagcgcacgcgcggtgtcatgcgtaccgacaacgttcatcaggttgtagaacacgtcccgcgggtagttttcgcgaatgcactccatgctctccgcgaaatgctcggcggtgccgccgttcaaaaagccgaggatggcgtctcgcagcgggtagttcatgacggaatccagttcgccgccctggaaatagcgccgacgctcggagtacgcaattttgttggacgcatcctcccacacctcaccgatgatgagcgcatcggatttctccctgcgggcggcagcgttcagcttctggatgaagctgtccggcagctcgtcggcaacatccagccgccagccggacgcgcccagccgcagccagcggcggaccacgctgtcctcgtcctcgatgatataatcctgatagctgccgtcggtctcattgacctgcgggagcgtgtagatgccccaccacgagccgtactcgttcggccagttgtgaaagtcgaaccagctgaaatacggcgattccttggactggaacgcgcctacgctgtcataatggccgcgtgcgttgaaatagcggctgtcgtagccggtgtgattgaacacgccgtccagtacaacgcgcatgccgcgtctggcggcttcgctgcacagcgcccggaagtcctcctcgcagccgagcagcgggtcgatgcgcttgtaatcgccggtatcgtagcggtgattggaatacgcctgaaagatcggattgaaataaatggtggtaacgtgcaggctctccagataatccagcttggcgtatacgccgcgcagcgtgccgccgaaaaagtcgttgttgaggatttcgccgtgctcatccggcagatagaccggaatatcgtcccagttctggtgcagcacacgcgggatcacgccttcaccctccggctgctcgggtgccttgtcgcggcagaaacggtccggaaaaatgttgtaggtgatgccctcaccgaaccagcgcggcgtatgatactcgccgtcgtacacggtcagctggtacttatcgccgaccgcctcgagcagctccgcctgaccgccgtagccgcgtgcacagtagtgcagaccatccgccagctccaccgaaaaataataccagtacagaccgggatgcggcggcgtataggttaccgtataccgatcatgtgagccttgatagccgcaccagtgcagcggatgggattcggcctgacagccatcttcctcaatccaaagggtaacctgcagcgcgccctgtgcccgctgcggataaacagaaaactcgaccgcctgccctgccggtaccgcgccatacggcttcttgcatgcagtgctgcgggagtgaaacatactatcagaaatgcgattcacgcaagctcctccaaacatatatcctcttgccaaatcataccttaccattatatcagcaatattggcggtattacttttagtatagcacaaaaccgcagaacggtaaacaaaagctgtcgcacgaaagaaaagaaaaaccggttcaatacaaactttttaggcacaaagcaaagagctgactccaacggagtcagctctttggatccggttttgattttagccgagcaggttcaggatttcttccttcggcatagcgccgacagccttattggcaacctcgccgttcttcatcacgatcagggtcgggatggagacaatgcggaactgcatggacagctcgccctgctcgtctacattgatcttgccaaccttgatgtcgtcacgctcgtttgcgatctcgtccacgatcggcgaaaccatgcggcagggaccgcaccacgttgcccagaaatccagcaggaccggcttgtccgacttcagcacttcgttctcaaaattttccttcgtaatggttactactgccatattgaacactccttagcctttcagtgataattcatagtaaaatgcatactgctgcatgacacccgcaaagcctttatagcgtttcagcggaaacccttttggatagtgtgcgtccagcatttgccggatatgcgtatcgaccggaaacgcgtcgatgtgatgcagcgcaaacagacagatacactccgcaaccttgatgccgacaccggtcaggcgcagcagctcagctttagcgtgagcgtaatccatgtgccggaccgcttccagatcgaccgcaccggacgcgacctgccgtgccgcggcgcaaatgtatttggcgcggtagccgaggcgcaccggcgcaagatcctcgggcgtgcacgccgccaggcgctctgccgtgggaatgctattgtatacctgttcactcttattataacaggtttccccgaaaagggaacacaaattttcgacacacttggtaatccgcgcgatattgttctgctgggagataataaagcatagaatagtctcccacaggtcctgccgcagaatacgcagtccgccgccgtatgcaacggcgttctgcagataggtatcgcgtttagcaactgcggctttgcagcggccgtagtccgcatccagatcgaaatacggccgccagatggcgttaaactcgtcttcatcgcagtcgaaccgtacggtccggccattctgctgaatattcagcaggtgtgttcccgcaattaagttgtacgacttatccccaaccctgtggaagcggaagcactgaccggagtttgcaatctggtcgatgtcgaaatcgttcagtatgcgctcgatcattggtgcatagcctcatgctcgcgcaccagctcggtaaacaggtcactcagcgtccagccgatattgtgctcggtgaccatggctttgtacggcacggaaacaccgtatgccttcatttcacggagcagaatgtccagtctcttttcggtaaagccgtccagcaccatcattggtgcggaaggcgcatctgcagtctcttcagtcggctcaaagcccttgcggttcagcagaaagccgaccgtctgaccggcagagactgcttcgacgttcttaatccgcacgcccatgcgaacgagcacggtcttgagcgccgcagtctgttcgctcggctgcggctcaaaatataacactttttcacgggatgccgccatagtggaatcctcctgttttattcccataagattgtatactaatattatatcatttctgtcaacccctattgacagacggtgtattcggtgctatgctcatagttagcaacaactaaccataaaaaagagaggtgtttatgatacagcaggcattgctttgggcggccgcaggcacaggattcaccttcctgatgaccacgatcggcgccgccatggtattttttatgaaacggcagtccagtgcactgatgcagcagatttttctcggattcgcgtccggtgtgatgatcgccgcgtccatctggagtctgctcattcccgcgattgacgaggccgcgcagaacggccagccgggctggatacccgctgcaggcggctttatcctcggtttggtgcttatgcttacgctggacggcttaatgccgcacctgcacagcggcgcagagcaggccgaaggtctgccgtcctcctttcgacggacaacgctgctcgtcctcgcagtgacgctgcacaacattccggaaggcatggcggttggtctgtcctttgctcgtgcggcacagcataccggcaacgcaggattgtttgcagcggcaggcgcgcttgccatcggcatcggcattcagaatttcccggaaggagccgcagtcgcgcttccgctccatcaggagggactcagccgcacgcgctcgttcgtttacggttcgctgtccggcattgtcgaacccatcttcggcgtgcttgttgtgctgtgcgcgtccgcactgacaccattcatgccgtggctgctgtccgccgctgcaggcgcgatgctgtacgtcgtggtcgaggagttgattcccgaggcacatctcggtgagcattcgcatccgggcacacttggtgtgatggcggggtttctggtgatgatggtgctggatacagctttgggataattgaaaatggagaattgagaatggaaaatgaagtcttccttctccttccacaaaaacgaaaagcgtcccaatgggacgcttcagtctgtcaaaaaagtattattttaatttttacgcttcgtgcggcagcacgcataaaatagaatttgcgaagcaaattcataaattccgggagcatgtatctcggaatttatacaagggaagaaaaaatgtgcccgtagggcgcggtttttcttcagtattcgctcgaaagcgtggtttcgagcgagaggctgctcggaaaacgatagtttttcgacagcctcaagcgtcccaatgggacgcttttcgtttttcagataatccgtgttttaactttgccaaacacaaattatcctcaatatctattatgaatctgtttgcggtaatcaaaatagatttgccgcaattccttcagatttttcttgcgaataagcactacatcaccgtttgtaagggtgaagtccttatccacagctttgacatagttcatattcacaaggaagctctggtggcaccgcaggaaacacggagccgtcagttcctgctcaatctcgccgagctttttatataatgtgtatgtcttttgccccgcctgatgcagaatacactgtgaattatggctttccacatacataatctcttcgcgcggaatgtgcagcacctgcgaacgattcttgatcgcgtatgtattctcgacgatatcggacagtacgcggtgcatggttcgctcgaacgtctccggggtatatggcttgagcagataaccggatgcaccgacttcaaagctgtccggtgcaaaatccagcgcagcggtacaaaatacgatcgtgcccttgtagccgatctcacgcagacggcgtgctacatcaataccgagcggcgggtccatcagaatatccagcagaataatatcaaaccatccgccgtccccaagctcataatagagcggttcaccgctgtcgtacattttgtaggaatagtcaatcgcatgtgcattgcagtaatgactgagaaaatccgcaaggatatcccgttctaacgccgaatcatcacaaattgcgacccgcagcatggttattgacagtcctttctcgtcagtttttgtcgaatttcttaacggtttctaaacatgttctgccgatttcacaagattctgctccaatttcacagaatagcaaaaaccgcgtaattcttctgataaaatgaacatgttcccaaacgaagtgggaacatcagcaaatatcgacggaggaagcatcatgtttgtctacaaagtaatcagcaaaaaccactattcgcctgagaccggggcctatatatctttcggtatcagtgcccacgatccggagcacggacaaacctgcttcgttcccgatgtgttcatcgacgagtcggaagcacgcgcctttacagaacgcctgaatacgcttcaggtgtcgcctatccatttgatcgatgtgatcgaggacgcattgggcgtttaacacgcagcttacataaaaatgcccagctcagaggccaacgagcgaattgcatgcacaatgcggatgtattcggtcgtgacttcgtatcgaagttccgtgatttcctcatcctgattgccgcgcagcgcttgcaacagtgctgcgctcttcttttccagccgtataaagccaaagctgcgtgcctgtccggtcagcgtgtgtaccgctttgattgctgcatcacgatcgtgccgacccagggcatcgttcaattccgcgcagcaaggctcgtccaaaaatcggatcaggaatttctgcagcatattctcgttgtaaaaccggcggcaggctgcttcaaaatctccatctattgcttgataaaatttatgcagagacatatcgacatctccctaaacatattttatcatttcaaaaatcggctggcaaggggtgaaaatagttttctatcgccatttctcgacaaagatcgcggtttacagtaaaagaaaaacgcctgatcaaatgatcaggcgtttttcatggagctgctaaccagatttgaactggtgacctcatccttaccaaggatgcactctaccgactgagctatagcagcgaaagaaaaaacggcacgattacggtaccgttctttggcgacccggatgggacttgaacccacggcctctagcgtgacaggctagcgctctaaccaactgagctaccgggccatattaacttaatttggtgggccttcggggacttgaacccgggaccgaccggttatgagccggttgctctaaccaactgagctaaaggcccatatagggaatcgactttaccctgccgtcacaatgaagtgacggcaaagcattgtctgagtggctcctcaagttggactcgaaccaacgaccctgcggttaacagccgcatgctctaccaactgagctattgaggaatatcgagcggatctgcgatccgcaggtgtaggcgttgagttatcttcccgggccgtcgccagccaagtattgtcaccgtaaacgagcttaactactgtgttcggaatgggaacaggtgtaccctcatcaccattaacacctactattttgttgcacattcctgtgcagctttattattataccataccatcagcctactgtcaacatctttcttaaagaaatttggtgacccgtgggagaatcgaactcccgtttgcggcgtgagaggccgccgtcttagccgcttgaccaacgggccataacagttagacttccggtatttctcggttccgctgtggactctctcgaacccacagcgcaccgaatctggtacaccatcacgggctcgaaccgtggacccactgattaagagtcagttgctctaccaactgagctaatggtgcatactttcttgtgtacaagaaagcatgcaaagaaaactttacctgcacacttcgtgtgctttactttctcattcacaatctgaaagtgtaatttatttctttacaccctcaaaactgaacaatcctactcgcaagctatctttcgaggttacctaaaacattatttattttgatagttgattcgttctccttgaattactggataacaaatcattttatcactatccagattttctacatgcatatctactgcactgatctgatggttttcataagtattgtaataataccatccttatggcagaccgtggttacgaaagttttaatacctttgcacacctgatccggaagggaatgtatttcgttatccgcatgaaagcgttcccggtaatgcttgttcatctttttcggcgagccggtataggtgagcagccactgcttgccctttcggaggcgtgcttcctttcgctcaatctttgtcattttctttgccatttgcggaatctcctggattttttgctgatgactttggtttgcgcttcttcggtgccgtcagctcatagctcaaagaaagcaggtctttgatggcatcatccagttctggtttgccaagctgaatactgagccatttttccttgttcatgtgataggccggaaaatagccgtcctgcccacgaagagagccgatcagcagcggatcacttttcacattaaggacatcaacgatgcctgcttccggcagtcccaacttatcagcagatacttccagaactacaccataccatttattattgtcattgtgccgcaacaccgcattccagtcatgccaggggtattccggctctgtgccgtactgctggcgtatccatataaataattcttgtcgtgtcatctcttataacagctcacttgcatcttaaattttctctacaatcgcgtttacatacaagtccgtcatattttcgctcaatatattattccgaatacttcttgaaattctctgcttgttccaaaacctctttgtaaacatcatcaatggttaccggaggataatcaaactcatccagaagcaaaatcaggtcaacttgcaaatttgccttaatatcatcacgggtagaccagtcagtgtacttagctttatcatcgacaatgaccttaatccttttcgacaattcgatcatcttatcgtccgggtactcgaactcgtacttcttagcaaccgccttgaggatgtcatagaatgctttttcttcatagtcaattcccatgcccttgaaggaatctttttcctttttaagttcttcaaggagcttcgcaagctgctctgccacatcgtcaaggacttcgttagcgaaagcttcatcacgacggcgattattgtactcatcaacaacccgcttgaggcggtccgagaactccatgcccataatgcggttgacttttttatactcatcaatcgcttgagaaagaagcctctgcaataccttaattttcgtgtttggaagctggattgcattgatcttatccagatactcatcgctgaaaatatcaactgagatatgctttccggtttcaaacagctcctctataccatcagattgaattgccccctcaagaagttcacggacgcgggcattcatttgtgaaatgtcgggggcatcacccttagtgagtttgaaaagaatagaacgcacagcacaatagaagtgcagatagtccttctctctatcggaaattgcatcgctggaactgcatagattgaacgcttgcttcatacgcttgacagcagccataaagcgagtttccaaatcttccgtaagctggacatactcaacagcacggttgaggcaagcaagctgctctttcggtgatccgttgaagtaatccgtactattgaagttgcggaacatctgtgccaaaacatcaagctggtctttgacaatcgtgacagactgttcgacaccttcaaactcatcggtttcaaagttggtgtacttcttgagggcgagattcatgtttttcttgataccgatatagtccacaatcaagcccttgtcctttccggtatagacacggttgacacgggaaattgtctgaataagggtatgctgctggattggcttgtcgatgtaaattgtgtcaagtgccggtacatcaaagccagtcagccacatatcaacgacaattgcaattttgaagttggatttaacgttcttaaactggcggtcaaactccttgcgatcatccttcgttcccagcatttcataaagctctggctcgtcatctttatttcgcgtcatgatgagcttgatcttctcgatgggcttgagttcctttttctctttttccgtcagttgaaccccgtcagggcaaacctttttctctgcccattccggtctcattccaactataatctgataaaaagcgtatgcaatcttgcgattagagcagacaaacattgcttttcctgcgaccgtagctccttcggcaacgcgggtctcatagtggttaatgaagtcctccgcaactgcatgaagtcggtcaggatcaccgatgatcgcatcaatatgagcaaccgccttctggctttcctcaatctgatgctcatttgcaccttcaacagcacaacggtcataataatcttcaatttcccgaacctttgcctgatcaagagtaacccgtgcagcgcgtccgtcgtagacaaggttgactgtgataccgtctttgaccgcctctgtcattgtgtaggcatcgacaactggaccgaagacttcaatcgtaccatccacgggcgtaccggtgaaaccgacataggttgcattaggtagagagtcatgtaggtatttcgcaaacccataggttcgctctacaccttcagcagtgaccttgactttttgatcgaggtttatctgactacggtgcgcctcatcggatatgcagatcacatttgctctatcggtcagaagctccaagtcctcggtgaacttctggatagtggtcatgtacacaccgccgcttgttctgccttgaagttcctgacgcagtttttcgcgggaatcaatgctcacaacggtttcgtcaccaatgtactttttggatgctacaaactgttttgaaagctggtcatccaaatcagttcggtcggtaataatcaggattgtagggctatggaagaaggtactcttcataagcattctggtgaggaagagcatggtgtagctttttccgcagcctgtcgcaccaaagtaagtgccgcccttgccgtcgccttccggtctgagatgcgccttgatattctcaaacagcttgaccgcagcaaaatactgaggatatcggcaaacaatcttaagatctttatctgagctatcagggaaatagacaaaatccttgataaccgccaagagccgttctttgcggaatagtccactcaccatagttacaagggaattgatgccatccaattccttatcgtcagcctcaatctttctcaacgcatagaaaaagtcatacggagaaaagaaggaaccgtatttattatttgcaccatcgcttatgacgatgaaggcattatacttgaatagttcaggaatatcacggcgataacgcacggtgagctgagtataggcgtccatgatcgttgtattttctttgactgcgctcttgaactcaagcacaacaacaggaataccattgatgaagacaatcccgtcaggtatgcgtagctggttgttgatgccttcaatttcaaattgattgacgatcttgaacacgtttttctccggctcatcgaagtcgatcagctcaatataaaggtccttctttgtgtgatcctcgcggttgaagatgaagccgtcacaaatcattttgcagacagctttgtttgcctcgtagatcgtgccggaaatagacctcaggcgaaggatgatgctatcagcttcacttggggtaagcccttctgtggcatacctattcaagaggtacttccgcagatcgtcgataagcagaacctcagagcgttcacgatgaatctgctcaccattcaaatagatatatccttcatcctgaaacaactccataatggacatttcaagagaatgctcattgaagttcgccattatcatttccccctaaccgcctctgcatttctgcttcaaaggctttttctctttgctggaagtcatactcctgatacttcaatcccaaacgtgtcagcatgagtgtaccttcccagtcatcaatgttcgagtattgcgttgcatggtttacgtcagtgagaacgccgagaatcagacccgtacaatcgagtgcaaagtctatcatttcctgcacatccggatataaaacaggatgacggtctgtcaggttttcattgctcaatatacgctgttcatcgttgtgggcatagagcttattccgttgcattcggatgttctctcttttttttcttagcgcgcagaaccgtttctgatacaaggctaaaaactcaggaaaagtcaaatcaacctgaacagggatagtttcagcatctggagcatcaaatatagcaaaaagatgtctgctcatctcgacatgttccttaaaaaagagttcctcctgtggttttagctggtgctgatatgggatttgataggaatacgttgtcccctcatgttccacggtcattgtttctctgtactcaggaaataggtcttggttttccgcgcattttgcaaggagggttccaatggacacgactccatttgagctatcatacagtttggcaatctccataaagcaggctttcatcaaagctccgtggatcgtttgatagaacgctggtgacaacttcatttcttccgcgtattcatgctggttctttcgatactgctgcaagatgaggtaataggcttttgcgtcaaaagctccttgatgaagctcttcggcaattttgatcagcgtatccttatccatttttatccctcccttcgtagataaatgataatttagcggcttaactaaccagacggctaagtagcagctccctaatcgtttcgagcttccgtatttctttctcgttgttcaactttccagcaaacagaggatgaacaacagagttgaatctatccagaacctcactatcagggatggtaattggaaagctcttcaagtttgcttgattgattttgggctgggcagctcccgtaacaattggtgacatatttgtgttggacaaaaagaggtacaggctatcttcggtgaatccagctttaccttttagaatgtgagcgtggttgtttgcccagaacttcccaattatatgttgcaaaagaggatgtccactatcgtcaacgacataaatgccgtcttcactcaaaagaaggtactcgccgtcaaagatgtaatcatccacatagtctactattgaaactgcaccataataaggatatatacgcgccatgtctgcccgttctaacgaagagagcggtttccgcattgagtcaaagaactcggcaatttcatctacgcttccaaccctccatgaaattgggcagtttccgccaaacggtttatactcaacaaaccacgctttgtaaactgcttgcgcagtcgcaagcaaattatcatttaaccgccgctttagttcgatacgttctgtgatggtctgatacgccctcacaatgctacgttgcttatcaatagagggaacaggcagttccactttgcaaagttcatcccagtcaaagatttctctaacacttccgtgagacatatatctggcgtagcgatcaaactccggtctgctaaaccaaagcataaggtattctggatcaagctcattcttattcacaacctcaaacacggtatatgaacttgaaataatgcagtccttatctcgtaaaagggcaattgaaatcttttcgccattccgagacgtaacagggccgtatgcaaattgcccagtacgaataatcttatagttcgacaagtctgttccaacaatattcgcaatggagggaataaattgcttgctgatgctgacaccaagcaaataatcaactctcaaatccctgtttcgttcgtcaaccggctgaatgaaatctccaagcaacctatatccttctttcattgtgacacctcaccctatgtattttctgtgtgccagcttgacattttgctgtttgaccatagcatagtgcatagtcgtgtcgattttctgatgtcctaagagctgctggacttgctctatgggcattcctttgtctatggctgatgttgccaatgttcttcggaacttatgtggatggacacgaggcaaatttagcctttttccaagttctcgaagccgtctttctacaccgccgatttgcaaacggtcatgcggtgcggtcagcgagacaagcaacgctgaacaggtgtctgtgcggctttccagatagttttggagatggatttttgtcctagcatcgaaataaacgatccgttccttacttccttttccgaaaacaacgcattcccgttcattgaagttgatgtcatcacggttaagggcaaccatctcaccaacacgcattccagaggacgcaagaaggtctatcatcgcaagatcgcggacattgcagcagttgtcccgcatgatttccaatgcctcatcggtgtaggtttccttgatcacctttgccgtttttactttgtgaatccggcgtaccggacttttcacgatgtagtcctcatcctcaagccacgaaaagtagctggacaggatgcggcggatattatctatcgtgaccttgcttgacttacggtttgtctgatactctgttaggtactttcgcaagtcctcagttacgatctcttgtggctctttgtcaatgccggatagcattgacacaatggtctgacggtaatagctcaaggttttttctgagcagccttcaatgcgttttgcgttgatgaaacagacaaccgtgtcgacctttgcgctttctaccatgcccgcgctgtaacttagctctacgccactcagcaccccttcaaggacgctttgaagttgttttaactgtgcgttgttcagaaacggaagcatctgacgctgcacttcttgaatcagttgttttttcattgtcgtatctcctttgtttattctcagagaacgacttttcagtggcagttcttagggtaaaactctcgccactggtgagagtaatggacggtaaatgataatttagcaaatacagaacaagcaattttggttgaaaccgtaatcaataatcatactgtcccaacagctcttggcgaccttgttgatttcattgatggagatagagggaaaaattatcccacatttgatgaatttacctcaacaggttattgtctgttcttaaatgcttctaatgttacgtctacgggctttaactttgataattgtatgttcgtttcagaggaaaaggacaaactaatgaataaaggacacctatctccttacgacattgttcttacctctcgtggaacgctcggcaatgttgctttatatgacaagcacattaagtatgaaaatgtgcgaatcaactccggtatgcttatcatacgccctaagactaagcggctttctccatatttcatatatgccttattgaaaagctcatatatgaaggttgctattgaacgatttaagtccggctctgctcaacctcagctaccaatcaaggatttgcagaaaatcacttttgaaataccggaatccgatacagttcttgttgctttagaccgtaaatttcttgctgtcgagaaaagcatatcaataaacaataatgaaattggcaacctaaaagaactgagtaacgtattacttgctgagttaagccgctaaattatcattttccgatctttttaaagcaatgcggtcggtgattgcacggtaggactcgacgatttcacattgtctcgcgtaggaaggaacagggagctttatacggcaaaaatcatcccatgtaattccgcctcgaacactgccgtccgtcatgaaccagcactcgcgatcaaactccggtctgcgaaaccacatcatcaaatactcttcattcaagatgtcgcgatcaataatctcaaacatgaaatatgccggagatactattgcggggctacctttctcatagagcgcaatcggaagacgttcatcgcgtccaacgtgcattgggttacaggcaaacagtcccttgctgattagcttataccggctcaaatctgtgccaattacatttgcgacggaaggtataaactctttgtcgatgcttatgccaagaacagtgctggtgacttcctcggagttccgataatcaacaagctgaatatgtttaccaaggggttcataattcgatttcatagcccagctccttaaacacggtcaacaggtcagccttcgacttctcttctgcaacaagcagatcacgaagctcgctttgcagcatcttcattttcgtatcaaagtcgatattctcatcacggtttacaaactcaatgtaacggctcggaacaagggtaaaacccttctctgcaacctcatcaaaagatgcgctgtaacaaaactcaggcacattctgataagtttcttcatagccttcctgctgccatgcgtggtagacgctcgtgaccttcgcacggtcttcttctgtcagttcaatgtacttcttttcataggggcttcccatttgccgcaagtccatgaaaagaatctcccgctcacggttacggaagcgttttacctcgctattttcttcaaccacacgagcctttttgttcttattcagaatccaaagcgtaacgctgatgtcagtggtgtagaagaggtttcggggaaggatgatgattgcttcaacgagattgttctcgatgagctgacggcggattttcagctctgtgccatcgtcagagagtgcaccgtttgcaagcaggaacccagcaacaccgttctgagatagctttgaaacgatgttcagaatccagccatagtttgcattgctcgtgggtggaacttcatagccgtcccagcgcggatcatcagtcagctcattatcaccacgccattctttctggttaaaaggcgggtttgccataatgtaatctgccttgaggtccttgtgctggtcattggtgaatgtgttcgctgccatttctccaaggtttgcagagatgccgcggatagccagattcattttgcacagcttatacgttgtgtttgtatactcctgaccgtagatagagaccttcttcttgttgccgtgatgtgcctccacgaacttcattgactgcacaaacataccgccagaaccgcagcaagggtcatagagaatgccatcatatggttcaatcatttctgcaatcaaattgacaatgcacttcggcgtatagaactcgcccttgcctttgccttccgcaagtgcaaacttgctcaggaagtattcgtaaacccgcccgataatgtcattctctttatcgcccgtgttgatcttatcaatctcgtccagcagtgatgccagctttgctgtgtcgatgtgaagacgtgagtagtagttgtccggcagtgcgcctttcagtgcgggattcgctttctcaatcgtatagagggcggtgtcaatttttaacgcaatgtcatcctgtttcgcattctccatgataaaagaccaacggctgatctcaggcaggaagaacacgttgtccttcgtatagaaggcaacattgtcaacaaacttctcaccgtatttttcagaaatagctttcctttgtgcctcaaacttatcactggcaaacttcaagaagaaaagactgagaacgacgtgtttgtattctgctggctcaacagaaccacggagtttatctgcggacttccacagagcttcctccatagaaatttctttcttaggtttagatgcagctcgcgccatattgatttctccaattcattttaatatatctcgcattcatatacactactttgtaaatatcagttttcgaggtttttgcataataatccagttaatattatagacttatcagcgaacaaagtcaatttagaaccactcttctgcaagcagggctttcgtgacacgaaagcgattttctgcttgttggggaatctccccaatccccatagtacgctgcctgcggcatcgggctgcgcatccgttccggatgctttaacggcagttcctgccaaagaaaaaagcccggtgcagaatgagcattacgcccacactgcaccggacattccatcatcgactgctttgtctattttcttcttcctgccgaacttcctgctcatgcaactgctcttttttctgctcatcctctttcaggatttcttgcacaatcttctgagccacaagccaatcctgcatttccgatttggtcttgcggtactctgcataggagcttttctttcgttccagaagcatcgcatactctgcgttcagctcgctgatgcgcgggagctttttgtcagaaccgttctctttcttataggcatcaaacgcctttttcgctgcgctgcgtaaggccagcgtatcccgatgggcttcatagaactctcgattgtagccggatgccttatacgcagcgaaaatatcttttgtcttggcataattgattagatgcttccgcaacactgacacttccgacatccgtgcctcatctgcctttacagattccagcaacgcatcacatttttcagaaattccatctgccttttctttcagttctgcataactcttgattccatgctcctccatgaacatcatagcttttgccatttgcttcagattaaagactttcgcccagcgcgcataccctgcgcctttgcccgcctgcattttggcacggatatcaataaggaacgacaactccgccttctgatgtacctgcgccgaccgtgcgcttgtgcggtttttctctgcaaatttacttttatgaaccgcgttcccggcaatcacttcgccgagttcttcaaccgaatatcctttgccaagagagcggaaacgagcaaatctggcgtggcctttcccacgcagggcaggctgttttccatctttatactcgtaccctgcttcctgcaaaatttcaatcagttcccggaagtcttttggttttcttgccaatgctgcatcaatggcctcgcagatttcatcccgctgcgattttttctccgggtattccgttctcttcttccgctctgcatagggcttccggataatgaccgacaactggtgttccagacagacgatatcactgagcctcgccagcgcaagtccggacagatgaaaatcgcgaaattttctggtgcaatctaatgtagtcgaattaaaaataatgtgattatgaatgtgcgcacgatcaacatgagtagccacgataaaggcatgttttcccttagtaaagcgcatggccgtctcatatccaaccttgttcgcttcctccggcgtaatttctccgggcttaaaggattgtcgaatctgatatgcaatcacatcgtgtgcctgggttcttcccgtgatatgctcatactgccgtttggaaagcaggaattcttcatcacaggtcttagcatcacaggcatacgcgctgatatattttccatcttccgtctttgctgcattctcagaataatcagtacggtcagccagacactgcgctaccgtctttcctttattgatatgcagcgcaattagtcttgtagccgccattttcatattcctccatctaaaaagagctacccgaaggcagctcttaccaatctactattctcattttaacatccgttcccggtcataagctccctgcaaataaacggcctgcttgatgatttcttccatatcgaaatagacacacataatgctttcgtacagcttccacacattagattcgctgccgcccaccatttccatcagctggtcttccatcttcgattgctcagactgtttttcctgataagcagtctcttccacaaaatgattctctccatctgtttcctcgtaccgtaaatcataataatctttcataaactgaatatccatcgaatccctcctgaactcaaattgtcaaaacatcctctacacactcgcacagccgttccatcagttccatgatgccgcccgcaccaaccgcagctgcgaacagccccatctcaatcagggtcagcaggaacacatccgtccagctcgcccgaaccaccgaatagatgccgcagccaagaacgagcagcataaccggcgaaagcacccacagggatagctgcatcagcagattccagataaagcatagaaatcgcagcagaaacgcaaccggcagcaacaggattttcagcaccagcttcaacaaaaaacatacgatcttcatggatttcaccccttcgtttttcttttcatcttcattttatcgtacctgcttgccaaacaccacgatgtcaacaggtagaccaaaaaatatgtaacggcacagacagtttcatctgtgccatgtgctacagaaatcccgcacatttgcgccgtcagcgaataccagaaagcctcttcaggatcagcttctgcatctcccagagttcatccagccgtctctgcaaatcccggatatcctccgcatagatgcttccagattcattggcgcgttttgcgtactgattcaggttgttgctgcatcggcgaagaaggatggatacctgcgccacatccgacaaatcaagatttacgcagtacccgtccatcgccatctttctcatataggcaccggtattccgaatacccaattccttctgcttttcacgaatcctcgccagctcttccgggttcacccggacattgatccagtgttcccgaacactcatagtgccacctcctcatcccgatgtgtcatcggcggaatgcgaccagcacggtcacgcagctctgccaggacagacggtttttccgttgttctctcacagtctggatcatcatttccacgatcatccatatttaacagtgcatccagttctgccagtcttgcactcttttctgtcagttctgcctcctggggaaacggctttccaagctcggcctgcgccgcttcctgctggctcctaagactgtccaactgctgttctgccttttccagctttgcaggaatcccggcaagagcattgtccagacgctggatattgcccgcagcactggtgccgatgagtacccggtgggtcatctcgcctttcagcagcacctgatactctttctggaaactgtcaaatgccagttccatcttgaaaccacgatagttgccaagcggcaccggctccagactctgattggctttacaaaccgcgaggattgcttcacctgcctcggctttttcagtaaagcgtgtggcattcacttccatgccgcagaacccttcttccggcagcggatgtgccgccaccgtccgaatatccgactgaaagcccttgatgaacccctgcgttttctcaatctccgcagggaaatatttcatcagcttatcctccaatcggtactgctggctctgatggtccgccttcaatactttcagccttgcaacatctacatccaagtccattttttccttgatttgcgggtctcctgcacaaagtgccttgatctccgcataggaaagagcctgctcatccacatcatcacaggaacgaaccggagatttgctggtcatgatctggctgatgaacttctgcttattctccagtgtctgatagaggtaggcatcaaaggttccttccgtcacgtactgataaacctgcacttctttgtttcggtttccctgacggatgatacgaccatttcgttgggtcatgtccgcaggccgccagcccacatccagatgatgcacggccaccagcctgtcctgcacgttcgtgcctgcgcccatcttctgtgtcgaacctaacaacacccgcacctggccggtacggactttggcaaacaaatctttcttttttgcctcggtatcagcatcatggataaatgcgatttcttcctccggcacaccggactggataagtttagcgcggatatcctcatagacattgaaggttccatcgttcttcggtgtgctgaggtcgcagaacagcagctgggtcagcttatccgactgtccttcctcataaatccgaagcacattccgcacacaggcgttgagcttgctgttggggtcatccggcagaagcggattcatcagccgctgatccagtcccagctttctgccgtccgatgtgattttcagcatgttatcgaccgacgggtctaccacgccggaatgtacagccgccgcccgttccgaaagctccgccaccatcgcctgctgatgctccgaaggctgcactaccacggtttcaaacttcgcctccggtaccggcagatgcagctgatcggaagtcttgatatccgccacttccttgaacatgttcatcagctccggcaggttgaagaattttgcaaatcttgttcttgcccggtatccggttccttctggtgccagctcaatggccgtggtggtctcaccaaaggtagaagcccagctgtcgaaatgggtcagccctttctgctgcaacgtgccgtactggagataccgcatcatggtgtaaagctccgtcatgctgttgctgaccggggtgccggtcgcaaaaatgatgccgcgcccgcctgtcagctcgtccatatattggcacttcataaacatatccgaagatttctgcgcttccgatgtggacaagcccgcaacattgcgcatttttgtgtagaggaacaggttcttgaacgcgtgtgcctcgtctacgaacagccggtctacgcccagctgctcaaaggtaatcacatcgtcttttcggtcggttgcccggagtttctccaatctcgcctccaatcctttccgggtcttttccatctgtttgatggagaaacgctcgccattctgggacttcatctcagcaatagcattttcgatttcatcaatctgggcagtcaaaatccgctcctgccgttctgcggacaccgggattttctcaaactgagaatgcccgatgataactgcatcgtaatcgccagtggcaattcgtgcgcagaacttttttctgcgggcagtctcaaagtcctttttgcttgccaccagcagttttgcactcggatacaggcgtaggaactcgtttgcccactgaagggtcaaatgattcggaacgacaaacatggatttctggcacagtcccagccgctttgcctccatagcagaagctgccatctcgaaggtcttaccggcacctacctcgtgggccagcagcgtattgccgccgtacagcacatgagcaatggcattctgctgatgttcacgcagccggatctccggattcataccgccaaagcggatatgagaaccatcgtactcacgaggacgggtactgttgaacagctcgttatacttttccaccagttccgcacggcgataagggtctttccacacccaattctggaacgcatccttaatggcctgctgtttctgctgggcgagggtggtctcctttttattcagaactcgcttttgcttaccgtctgcatcctccacggtatcgtagatacgaatatcccgcagatttagcgtatcctctaaaatccggtaggcattggcacggctggtgccgtaggtcatataggcatggacatcgttccggctcggtgtactcttgccggtaatctgccattctgccgtcatgggagagaatttcacttcaatatttcggcgcagatagaacggcggttcaaaggtttcttccataaactgctggatataatcccgattgacccatgtggcaccaagacgcacatcaatctccgaagcatccaggtcttttggctgtgccttcttcaaatattccgcgttcaccgcaaaggcagggtcagaggccgcagccaactctgccacgcggagcttttcccggacattgccggacagatattcatcagctgttacccagccggtttcctcgctgccctgcgtcatcgggtctttgaaaatgacaccatgcagttcctgctggattttttcatattcccctggtgtacctaaaagctccgacatatagggcaaatccactctgccgcgctctccaatggagattgccagagcttcagccggagtatccacgctggtaacagcccgttccggtcgaatcgtccgtttggtgaacatatccgccttggattccagcctgccgttttcatccacattttccagagagcagagcagataataagacgaatcttccgaaaaagcctgtgcatttgcacgggaattgataagcccatactgatcggcgaatcggtcataggctacattcagttcccgctgtttctgggcaatcgcttcctcctggtaatcgttcaactgatagtcgatcagttcctgcacaatggtgcgaagctccaccatgcctttgatcctgccggtggctgtcgcagaaaggtcagccttccgcatgatgctgttctcacggaagtagacatccccatccactacggcataggagaagttcttgacattggggtctgccggaatagtttcgccctgcaaggacaactcctcctccggtgccagctcctgtgcttcataatgaccgccgatgtgctgcaccgcctcatgcagctggtctcccagatccgcacctggaatcggaatgaccgtacattcttccttgccgtactgggtactttccgttgtaatctcacccagcaccatttccgggtggtcaacaaagtagccgttgagggtaataccctccgatgtcagccccagatgcacccaatccggttcgatatcaatgggatggtctctcttttgcaggaaaatgatatccgacaccacatccgtaccggcattggcacggaatgcgttgttgggaagtcggatagctcccagcaattctgcccgctgcgccagatactttcgtgcgtccggatttttggaatccatcgtatagcggctggtaacaaaggccacgataccaccgggccgaacctgatccagtgccttggcaaagaaatagttgtggatagaaaatccgagtttatcatatggcttatcgctgacacggtaattgccaaaaggcacattgcccacggccagatcataaaaatcacgccggtcggtggtctcaaagcctgccaccttgatttctgcctgcggatacagcttttgcgcaatacgcccggtgatggaatccagttccacaccatagagcctgctccccagcatggaatccggcagcataccgaagaagttgccgacacccatcgacggttccagaatattgcctttctcaaatcccatactgtccaatgcctcatagattgcacggatcacggtagggctggtgtaatgcgcattcagagtcgaagccctggctgcggcatattcttcttccgtaagagctgctttcagctccttatattcgcctgtccaggcagttttctctgcgtcaaaggcatctgccagcccaccccagccgacataattggccagcgtttcctgttcttccggtgtcgcatccctatgctgattttctaaggctttcagcgtgtagatggcatccatgttggcacggaatttctgcttaggactgccttcgccgaggtgaaagctgttgatgcggtagttctccgcatgttttgcttcatgccctgcccggaacgcttcttcttttccagaattcagatcaaccaccagattgtgcaggtgaacattttcctcatgccccaaaattcttgccagattttccttgctttccgagcggaagatcggatacacggaatccgggtcccgaagttccacatcgaaaagcccgactttttcaatcgtaaatgcctttccgtccagatacagcgtatcgccaacgcgataatccggctgcaccggagctgcgggttctggctgcacagttgcaggctctttttcagcctccatgttcctgccgcgaatctcctgcaacgcctctgatgcactcacataatcggcaaatgtctgcacttttccgtccgaatatccgtaatactcttctttgacataatcccagatggcaaacgcatctttagaatccggaaagttctcgccggtcattgtgaccacaaaccgttcatccggtgcatagccagactctctggaaagttcgctggcgtgttcctgcatttccagtaccagaggatctgtctctgcgtgagccgattcctgtacttcttcggattccacatctgggaatggaatgtcctgctgcaaattctgcttgctctgttcaacatagagccagtcttttgcttcccgttcctgaactttttcaatcaactgctggcggtaggtctctgcctcccattcgctggtaaactcttcgctgacaccatccggctccacatgaatgccgtcctgaatatcatcccagaccgcataaccatcgtctgtctccatcacggtaaaccgctgtggtgccgccagttcactccgggcatatacatccgcagccgtattcagcatgttgtccacatgctcatttccggtatcgtagcgttccggtggcgttggcggaaacacatgggcggcagtcggcataggaagcggcgcgccgtattcctgctccagcttccgatactcttccatttccagcgcggtcaggtactgatcattttccacaagccggtctaaccgcttatccaccgccgaccatgtgagtcgcacttcccggtcatggtcataattgcgaagcagaatacctcttccgttataatcggcaaaaccgcgactgccatccataaaggtatagctgtggccaccgagaccgtattccgctttcaagaatgcagctcgttcttttgcgtccccttgctgctgatacagcgcataaatacggatctttccgccttcaaaattggagcctatccgcagcatccggtcgatttcatcctcagaaataacaaaagcggagggcttttcgctctccgcttctttggctgcattttctgccgccgcatcaattttctgaatctgctctgcttcggactgaaacagactcatgaagtttaactgttgataagttccgtcagaatgacttcctctgcctgcgctttcagcatgttcatgtgctgcacccaggccatctggttcaatttcttgtccggtgccggattcgctttcagaagatccgccatcatctgctccatccgtgcggtcgcggtctcctgaatctcccacaggtgcgggtacagcttctcggtcaggatcaggtgattgtacagcagcgtgttgttctcctgcagaaacgctctgcgcatcctcccgtacttgcccaggggcttctgttcctgcaccgacaactggatgtccggaatcaggtaatcgccgttcttcgtgtaattcagctccatcatagttttggctcctttctgcctgcttatctctttcataggttcggatcgtgcgttcaatttcccggaagatctggctggacatttcgctgaccgcagttcccagcacattggcggcagcctgcgtattaaaatcaaagatgtccagaaaatcctcgtgctcaaaatagtcatctgcattgcccaccgtccgggtaaagacggaatatgcgatgctgacagcggcagctctcttaaaggaagctccgatgttgagttcatcatatccttccagataggaatctgcaacgatgtcactgatctgcctgcgattttcctcccagtaatcccttgcaaggcgttctgccgcttccatgatatgattttccagagacccagcaccggcagaaacatcaaatgctgcatccagtgcgcgaatgattggctgctcatgctccgcattcattttccagagctgtaccggtcgggaattcttccgttctccggtatctgccacatcaaatacataccgcagtttcggctgctcgccgcgcatgtccaaaagagcaatgcccttggagccacgcttcacatagcggttcatccgatcattccagagatcgtactctgcacaggccgtcgcttctggtctctgcttatagatcatcagctgctccgcaaaaggatacttataaagccgtgcggatgtggtcagaaacgctgtccactgctctttgctgccagtgatctgtgccgcagcttcctgcgccatctgcatataataagccgttttcgtcatcatctgtctttttcctcctctcctttattcgtccggatacaaatccagtgcctcatattctgcatccgtcatctctgccagttttgcaagcagcgaggccgtccacctgcgcaggtttctgtctctgcccgtcagacttttttgcatcttttgaagctcttcgatcagccctgtccgtgtgccagggctgtaaagcatcatgagcatccattcgtcatccgtaaaacgcatttataactccttttcttcgcagcacctgcgaggcggcgcaggcggcacagcctcctgcttttccttcagctgatccagaaccgatgctttctccaccggttcttccttctttccgttattgattacgccgtcaatcatgccgtaatcgtcctccatcgccatttctgcggctttcaggtagttctccggtttcaaaaatccgggcagttcctggaagccgatggaatccacatagtgacagcttacaacaccattctgccgtaaagccacgatgtcagacacagaaagactatgaccagtaaaatcatcagggcgggaaacattgaatttcgcatacagttcctccaacatcgtattctgatccttgtagggaagaagcggagccgtataaaccacctcataatggtcaatatccggttccagccccatccgttccagttcgcgcatagacgaaaagcgttcatataccgtatcctcgctgcggcgaagctgcaaaatcgcatactggtcggtagtactgtcgagaaatgccatcattctttcgtccggtgcctgcgttccatgcacttcatcccatttttcaattcttgccatcgttcatttctcccttctccataaacggcaggccgttttcctttgcttcctgccgctgctgttcccgccgcttttcactataaggcggtcggataccgacgcagcgtttcggaatcgtataagtgaccgacccatgctcctggtgctccaaaataaactgctccggatactgttttcgcagttcccgaagcttcttaatcaggcggctgtcatgggtataaatgctggcggtatccagttcattatcaaaattgatgacggtttcctgctctgccttcgtaagcttgtatttcatcgctctgcctccttcgccttggcagctttcaccggcgtatccgttctggaagacaaatccgagagtttacccagcacagattcccgtctgctgatttccgcttcctctgcacgatcacaaagttcatcatagtcaatccgcgtcatggtgcgtccaccgaacccataatccgaaagaatctggtctctggctgcattcatgctgatttccgggttgtcgatctgtccgccgtcaatttccgtgaagtccttatgatataaggtatagtcgtaaccgtcctcacaggtctgaatggcaagaaagcccttgcttcccaaatcccatgcgctgtgttcttctgtaatcaatggctccgggcggcatgtgccaccgccgcgttccagcatttctgccagctgacagatgtgcagaacatcatacccaaggcgcagatgatattcgtccatatattcgcagcgggctgagaattttcgattcggatactcgacctccaccgcactgccatccgggattttgaaccgatcctcgtagttgctggtgataaaccggatattttttgcattctccagctcaggatcagcctttttcatctgccaaagaacctttctgccgcctcgcatctgctccaacatctccggggctaccggcgcaacggcaagaccgtcaagctggggaatcttctggagtgccgccatcctcgcgctttcttccagcgtagaaaacggctgtttatccaacacatcccagccaatacgtccttcggcggtctgcaccttactgttcatatcaaagcagtggaattccacgccgtcctgcttttcctgcaaggaaagcagagcgacattatccaccagataagctgcattcatcattttcatgctcattttttacctccaaactccagcttaaatgctgctgcaccgtcctcgccagtctctacacgaacggttgtgtcatagtaacgtccagacttcttggaatagcaatgggtaagtcgtgctttcccctgatttaccagttggcttgccagttcctctgtcatctgctttcccagtgtctgaaagaacctgttttccttccagagcgcaaatttacagcccttatccctgcaaaaccatccctttgccgtttcacagacatcattgccgcaggcggggcaggaaccaatgactttccgttccggctgcatcagcacatcagcaccttttacagcctcgtaggttttaacaagtccgctgaccatgctgctgatttcgcccataaaggcatcgctgtcgtactcgccgtgttctattttcagcagtttttcctcccagtctgccgtcatggatggggactgaatctgttccggcaccaccgtcaccagcgcatttcccttgtccgtagaacaaagatatttcgttttcttatcacccctgcgctcgataaagcctttctgtaccagtttttcgatgatggcagcgcgtgtagccggtgtgccgatgccttttcgctctacaccggccggaaattcatccgagctggcactctccatcgctgaaagcagaagatcttcggtaaatctcttaggcgggctggtcttgccctctttcagatcgacaccggcaagttccagtgtcatgccttccgaaagtatcggaagttcacctgcctctgcattcttctcagcatcttcaactgcctttcctgcatattgcctccagcccatatccgtgactgttttgcctttcgtgcggaacttctgaccggcgcactcggcttctactatggtctctgcatagcgacagggagtgcctaccgcgcaaatcaggcgcaccgtcagcatggtaagaatcgcctgttctccactgggaagcgaggaaatgtcataacccgccgctgtttttgtagggataatggcatggtgatcggtgactttcttagaattgatgacctgcgctgcattcaccggtgccggtacatccgcctgaatctgaaagctctgctggatcacagaaacaagttccggcaccagcggtgccatatcatccgtcagataccggctgtcggtacggggatatgtcacgagtttcttctcgtacagagcctgtgtgtaatccagggtctgctgggcagtgaatcccagctgccgatttgcttctctctgaagcgatgtcagatcaaacaaggccgggggcttctctgatttttctttctgctctaccttggtaatgatggcacttcctgcctggcaacactctgccaccagtttttctgcttctgctttttctttcattcgctcaccgcccgcttgaaaatcccgaaattttaattctgccgagtagaacggctccggcttgaacgcccggattgctgcatctcgcataaccaccatcgcaagcgttggtgtcatcacgcgccccacattcagggtctgcccatacagacatgaaaaaagccgggtggcgttgattccgacaatccagtcggctcgctcccggcataaagccgcctcatataaggcatcatattctgttcccggtctgagcttctgaaagccttcccggatagcactgtcctccattgatgaaatccaaagccgttccaccggctttttgcagccgcactgatggtaaaccagtcggaaaatcagttcgccctcacgccctgcatcggttgcacagatcagactctccacatctttccgctgcatgagctttttcaggattccgaactgctttttcgtgctggcggacacctgatactgccaatgttccggcaaaatcggaagatcatcatacttccactttgcatacttttcatcataggcttccggctgggaaagttccaccagatgccccacacaccaactgacaaggtagccattgccctccatataaccgtccccgcgctgatctgccccgatcactttcgagagactcatggctaccgagggcttttccgctaatacaagcttcattcgatactgctcctttcgcaaaaaaattagcagccaggcaccgaagcgcatgactgctatgtaaggaacggtattctgttttaggtctacaaactggggcttttatgatcttgccacagcttatcagtctatgcacgtcaactgttgaaaccgccgtgtaccgaacggtacgcacggtggtgtgagaggacggcggctagtcaccgcctcctactcgcttgtgcccatgtttcggccctccacatcatcactccgcgcatgcgttgtgcctcgccgcaacgcattctgcccctcgctgactcatcgccaagcatcgctgatggtgttcgtctgcccatcctcacttctgcagtatctgcttttcgttctcctgcacacgccgctcgagcgctgtatactgccggagctcgtcctcggtaaatccccggaacttcgcctgctcgtagtcacgctccgcggccgcgatatcctgcagcaccgcatccgacgccggcagcagctcgagacgaatcttccgcggctcgcgttttttcttcgtcattccgttcgcgtctgcatcctgtgcctcgccacgctttccgaaaagaccggtcgcctcggctatttccgccgcttcacgtcgtttcctcggcacgtcgaccacttcgagcatcccgcgtgagaccagcttctgcagcgcggcgcgcagatccccgcggctcatatgcatcagctccgcgagatccttccggctcagcgcctttccggcatcctttcgatcagtcgcctccacggcatcttcccgcgcaggcatctgcgcttcagcccctcgagtgagcgcctttcccgcgtccttccgatacagcagcagcgacagctccgccagcgtcatatcatacttcagcgccaccgactcgagattgcgctcgagcagcttccggtcgcggtacttctccacgatgatcccatcctccgaaatcacctcctgcagcgcctggctccgctcctcaccgagcttctgcgtccccggaatcgtcgccgggaacacgaaaccatccttcgccgcatccactagaaaatgatagacctgcagccgcttccgctcatacgcatcctcatccagcacatgcttgaagaagtcgttgtagcactcgaacatcgcgagtttcatctccaccgtccgcgcgaagctgatcttctgattcaccagcgaacccttcgtcttcacataatagtagaccggcgtccgcagcgcatagaacgtcgtcgcatagcgcacatactcgagattaaacagaaaatcctcgcaccagctgagcttcgcatccatccggatcccgtgcgcctccacaagcgagcgccggtacagcttattccacagcaccccatagtagtagtccgccgggttctccatcatgaagccaacgaacgcttcacgcccgatcacctggtccgcgtcgatatcccccttccgcgacaccatctctccgacgacacgatagaaatccgcgatcaccatgtcgcagcccgtctcctcggccgcccgcaccatcagcttcgtcgcatccgccgtcagccagtcatcactgtccacgaactgcagaaacgtaccccgcgcccgcgcgatcgcctggtttcgcgtatccgacacccccgtattctccttatgcacgaccaccacgcgcgcatccgcccgcgcatatccgtcgcagatctccccggaccgatccttacttccatcatccatgaggatcagctcgaaatcccgaaactcctgattcagaatactgtccacacagcgcgcgagactcttctccgcgttatacaccggcacgatgatactgaccttcggctccataggcacctccatcaaaaaactacttctagttgtaccataaaaccctcccgttgacactcgtatatttctgctcacttttcccgggccaatgtctcggccctccgcctgctcactccgcgcccacgcgtccgcaccctccaccttctcacgtcgcgtccacccattcgcactcgttgcctttatcgcgcccatgcctccgcccactacctcctcacgtcgcatcgaagcaccaattccctaatgaaaatgtcatattacagcataaattcgctcatgaaagtgtaatgaagcacggattattccctcatgaaagtggcaaaatactgaaaagaacgctcataaaagtggcagagcacggaaatctgaatggtaaaattccgagttgttgagctgttcttactttctattttatcagatatcgcctacagagtccatagcttcatagctcaaaacagttcacccaccaaccatttggctatgtaaaggggacggcttttcagccgccccaccggtcaacgctgcgttaatcagacaggttcatcgtccgattccgcttcataatcctcgttgacatccacttcttcgtcctcgtcaccatcatcctccggcagctggagcgtatcttcatcctcatcgtgataatccgcatccgggtccggctgatttttcttggacgcaggctttacgcccttcatcttgatatagagataaccgccgacaccggctgcaccgatcacaaacagaagcagcataatcatcggaagcggagacgatttcttctgctcgctctctgttttctgctcttccggtgccggttccgtctcctgcggcttttcggtttccgcaggttccgtgacttccggctccttctcccgatacttggcagcttcctcttcatccatcagcgcaagcagatcggcctcgtccaccatgttcaggaaatgcacattctggttgccgtctttatcgcggtcgatgatcagataaaaggtgttgcccgcctttgtcaccagcgtaatgaactgctggctggatttatcttcttcctcaccgatatcgtccaccagcgtcatatttccttccggagtcaaagctgcactggatttcgtctcatcctcggatgacattccactctgcatcagatccagaaacagcttcagcgcatcttcactgaacatgctgctgtcttttgcagaatccgtgacattcaggtactttccatgtgcatacccggttttgccgttgaagtttaccttataccagtcaccgcatttttcgacaatctccaccgtatcgccggaatgcagatatccgataatctcctgatccatgccgggaccggaacgaaaatgcagactggtgatccccggcaccaccgtaccagtctgcttttgggacttttcgctgctgatattgtattctttgccgcccaccgtaacgatcaggttcccatccgcatccgtagagacctcatagccatccggcagaacctgcatgtccgggtcgatttcgatgctgtcggtattgtccgttttccccgcatttgtgctttctgctgcatccgtctcctgtgcagcggtactgacaggcgtgttcttctgcacatcatcgcccgtataggcaaatgcagtggtcgtaaaggttcctgccgccatcacgctggcaagcagcattgccatcatctttttcattccatatcctccgtttctttctcatccagtttcaggttctccgggttgggaaccgcagcctgcgccagctgaatgatgactgccagctgttccggggtcaggctctgggcatgtaccatttcacagatttcgctgttttcctgctcgtggtactttctgtcccattcctttctgcgctcctcccattcatcgcgtttcctgcgggctttctcgcgctccgcagcaatcttttccagtttcaagctcatatcgtatcctttccgggcgaataaacgccctatttttatcgaattcttcccatgcagtagtagtgctgccgccagtagctcgtctcaatggaagcataggaaattggtgagccacagtggatcatcatcccgttgccgacataaatgcccacatgggatgcgccactggtgttgtaggttttctggaagaagatcaggtctccgggctttgcctcactcttcgggataatgtcgcattttcccatcagaccgttggccgtctgcctgcctacattccagccattgccgcagtggttgatgacccagcttacaaaaccggagcagtcaaaactggtactcggcgagctgccgccccaaacatagggataaccgagatatttctctgcttcggtaatcatcttccggaatttttcatccgtcagagcttcgcccggaatgtcgtaatcctggtattctccgctggaacccgcgccatccggcgttgcaaaggctatgcctgcaaacaggtcatctcgattgccccggcactccagtgtgacttcgtatcgttgcagctggtcatctgtaaggccggaatttcttgcaacatagtcaacgccccgattgagcagtgttacattgaggattttatactcatactgtaccgtcacctgataggtgtaggtgtgtccggttccagtgattggattgtagcgatagcccacacgggtttctttcctcgtccggatttctaccttttcctccaacttcagctcatactgcgcttcaaagatactctggagccgcgcctgtacctggcttctcgtatagttttcaaattctacggtcagcagagatgcaagctcatagggattgtgaccgatctctgccaaattgtagcgatactcgtcatagcccggatggtcggcttcaatacggtcaatttgtttacgaagtttatcctccagcttggtataatccgtctccacgcctttcaaatcttcatcttctgccgtgtaggaagttcccagcaccacattgccgccgccattgatcaagacagagcaggacgatactgacccggcaatcaccaaaacaagcagtcccacggctgcgatgccaatgatgatatgcgagtggctctgcacaaactgaaatgccttttccgtcatactggcagtcccctgcgcagctttggctgtgccagctgctgtgttctccgcagcggccgcacctgtcttagcagcggcatactcttttttgatagcctgcttctgccgccatctggaaaagaagttcgagccagcctgcggatcagacttcatgcgttccgcaaagatggaatccacggcatctttatctgcctttttctccaaccgctccggctttttgtactgccgcagctttcgaccatattggaaccgggaaccagcacgggctgcaccttccactgagccttcggtaaaatgcgctgcctctacaccggaattattatcctggtcggcattacgcacactctgatgtgctttggttgaaagcccatctgccgcaagattccccggcttctttggctttccgccctttttcccggaagcggctgcattcttcttcgcctttacctcctgctccgatttcagcttcttgctgcgcatcttggcaagatcggcctcgtgacgaatctgccttcgatgttctgcttttttcttgctgctgtctcccgtactgctatcggtggctttgtttctggaatcgcgaagggtgttctccgcaccctcgcgctcctgccgcagcttgtctccgagattcggatttttcttaccagccattgcttacgcctcctttgcttcctgtacttcggttaatttggtcgtcataatccggtacagttccagatcggtcgggaaacgatcaacgaacggcaaaatcacatttccgtagaacagcaatccttcgccttcgccggaatgggtcacataggacagctggtgcgggctgatgttcagctgatccgccagaatctgacggtcaccggctgcctgattcagcatataaatgaaatcactgttttcaaaaatgttcgtcacttcgcgggaagaaagcaggtctttcacattctgggtgatgccggtgggaataccgccccatttacggaatcgcttccagatttccacgctataggccgctgtctgctcttctttcaaaagcagatggaactcgtccatatagtagcgggtggctttaccggcattacggttggcggtcacacgcccccagacctgatcctgcaccaccagcataccgatctttttcagctgcttgcccagctccttgatgtcatagcagaccagccggttattgatatctacattggtgcggtggttaaacaggttcagtgaaccggtcacatagatttccagtgctgttgccacatgatgtgcttccttttcatcctgccgaagcagcgcctcgtacaagtcctgcaacaccggcatattctccggcaccgggttctcaaaataggtctggtaaatctgatgaacacagcggtcgatgaccgtcttttctaccggctgcaagccttccttgccacccacgatcagctcacacagggacaggataaaatctgctttcagggcaatcggattatcctcttccgaatagttcgcattgatgtccatcggattgatatactgcgtgctggaaggactgattttaatgacctgcccctcaaatttctgcaccagtgccgtgtactcggcttccggatcgcacacgattacatcgtcatccgtcaccaggaacgcattggcgatttctcgcttggcagaaaaagatttgccggaaccgggagtaccaagaatcagtccgttggggttcttgagctttttccgatcaaccataatcaggttgttggacagtgcattcagcccatagtacagagcttctttcccggtctgaaacagctcctgggtggtaaaaggcacgaaaatcgccgtgctgctggtagtcatgctgcgctgaatctcaatcaggttctgtgccagcggcaggcagctcatcagcccctgctcctgctggaagtcaagacggcgcaggttgcagttgtacttctgcgcaatgctggaagcctgaaacacattggtttccagttcctgctccgtctcgccggtgttcataactagaaaggtcagcaggaacatacgctcattctgactctgcaattccttcagcagtgcctttgcatccttaccgtaagttgccaaatcggacggaatgatgtccatatcgtatccggaacggacagctttcttctgttcctcaatcttggaacgatccagctccgtaatggtgtgcttaatggacttgattgctttattctggtctaccgactgaatgtgcatggtcacaatctggctggattccatatccagaaaatccttcagcagctgatccgacaggtcggaagccgtgatctgaagataggacatggagccatacatcccacccatctgaaaaatacggttcttcggaaaggcaaacccggtcggtgcaataaagtcctttaccgacagcccgctctccggcaaccacttccaatcgaaattgaaacggtcatggtcacccatgtggaacacatcgtgcatcagatgaagccgttccttgccgttcagcacttttgcccgaacacccaagcgtttgaagttgttcatcaggtcgatctcgatgtgaatgagcctcggctttgcctgcttcatggattccgcctcaatgccaaacgtcaggtacttcgtcttggtcaggccgttgttgccctgggcaagctgacggcggagcatggtgctgtactccgtgcgcaccggattaaaatgatccttctggtacgggatacgcaccatcttctcaaaattcgaggcatccgtagccatattcataaaagaaagctcgaagcggatgctggaatcaaagaagttcaggaagctgcaccattcctcaaagatagctgtctgatcttcctgttgtgccagctggtaattgatgtcctgaaactgaatggttttggtatagtagttgtccgtcacacggcagataccatccgggaacatccgctgaaagggaatgctctcctgtgccgagtgcggaaccgtgcggtcaccccttgcacggtcgatcaccgtctgcacttgtttctgctctgcggctgacagatgagacggcattcggatgtcatcctgctttttattcttcgctgtcagcttttcgagaattttgaacaatgcgatttacctccatttccacgtcttcctgctgtaccagcagtgcatagtaattttttgttttgtaaggccgcgttttcggcctcttgaactttgcctcatagaagtgctttgccaccacttccagcggctgaccgtctttctcgtacatggcaagaaagaaaagcggcagcattactgccatcatgccaagtgcggcaaggctcagattcccgctggatttgagcaaaaagaaaaccggaacgccaatcagcgcaccggctccgaagcagagaatctgccgtttggtcaggttcataaagaccttggtcttgacctttgaaaggtctcgcggcacagaaatataagatgccatgaatcattcctcctctcttagtgcgctgcaaacacggatttcgcgaggcttcccgtcttaaacagcgtaaatgccagcaaaaccgtatagcccaaaacgccccaaatgctgctgatgatgttatccgaaaaggacaggttctgaatcagaactgcatagatgcctacacagatcatgataagaaagccctggaatcccagtgcaaacagggagcgcagatagttttgaccggtatggctctgctcatggtttccaaaggttgcgaacggaatcggcgcaaggctcaccatgagatatatttccaccattcggccatacacgatgacaaagatgatagccgacaacgccagcatcgtgacctgaaccacaaaggtctgcaaatacagtcccagcagcggtcctaagtccattccttccagcgtggcctgcattgctgtcagggtcgcatcgctgacggacgtactgccggaaatcagcccgccgcttcgggagatcacttgctgcgccacatcaaagacagccatcgtgatattgaatgtgttcgagatcagggtcactgccagaaaggtcttaaagacccatttgaaaaatgtccatgtctcgaaatttgccagattgttatgctcaatgagcatctggatcagctcataacaggcgatgaaagtcagcaccattccggcaatgggcaggatcacggattccgagatgttgcggatcatagaaaaaacagcaggtgaaaagttcgccggtgtggttcccacatcgcctgcgatctgtccaacctgctggttgaccgaatcgaacatccctgaaagatttcccatgataccgctgatgatcatgctcttgagccaatctgtgatctgttcaaggatactctgcatgagccgcctccttccttacgcaaacacgccgaacagcttcgccatccgggacagaagcatgaacagctgagagaaaagagacagtgccgatgcagttgtagtaagaaacgccatagatttgtcctcctgtaacttgtccggcctatccgccggtgcgattctaaactgcggttctgcgccatacttccaacatgtgcacctgccagagagcgcagaaaatagccagctgcggagattgcctgcacctgactatgtaacaggcagctttcgccgcccggccggaatcttcgctccgacagcttttgcttaaccgaacagaccggaaagcagcggcaccagagtcgtaccgatcagtgccacgccgccgccagccatcagctgcttcatgccctgagacttggcaccagggttgtcgttgccgtagccttccagcaggttgatggctccccagatgccgagaccggcacccagtgcgatgacgagggtctgaagaacggttactgcgctgttgaaaaatgccataaatgtgtacctccttgtacgatgcgcccttatgggctgataaatagtgaatgtccccttgcatgtgcatctgcaaatgggcaaaataatagccaggtctccaatttccatcagaaacctggctatgtaaaaagggcggctcaccgccgccctcatcagaattccaacatcgtatactttctgtttaaccaaaaagtccagaaagcagcggcaccagagtcgtgccgatcagtgccacgccgccgccagccatcagctgtttcataccctgggatttggcaccggggttgtcgttgccgtagccctccagcaggttgatggctccccagatgccgagaccggcacccagtgcgatgacaagagtctgaagaacggttactgcgctgttgaaaaatgccataaatgtgtacctccttgtacgatgcgcccttgcgggctaatgaatagtgattttccatctgcatgtgcacctgcaaatgggcaaacatatagccaggtctccaatcccaatcagaaacctggctatgtaaagaggcggcagctcgccgccccttcttattctgttgccaacagcacacctatgacatcttcgtcaccggaacaaacttatttggcatgatctgcatcaactacttcgtacttatcaccgggcttgagcttcagccgatgatcgagaaacgtctcgatgctgaacgtgtttttcttatcagcaccggcagtgagcttgtagttcggatgctgggtcagatcgtatttatctgacttgaacggtctgacaccgcgcagctgcaaaatgcactttccgccatccagcacagccagttcatccaccgaagccaggtcatgcccaaccttttggtaattggtgccgtaagatgggctgttgcctctggtatcggaagtgttgtacagatcaatcgtttcttttcccaatgcctgattcagctctttcagcgtagtcggctccgaaccgccaaggaaaatacgagaatccatattgccgatgatggtatcggcattgtccttgtagattgccttcaactggctctgtgcctgaagtaccagacatgccgagatttctcttgatcggatggtggctaccagcttttccagatttggaatctgaccaatgttcgcacactcatcaatcaggcagcgcacatgcaccggcaatctgccgccgtaaatatcatccgctttctcgcacagcaggttaaacagctgtgtatagatcatcgaaatcaggaaattaaaagtcgggtctgtatcgctcataatgaggaacagagccgttttcttatctcccaccgtatccagcgacagctcatcgtacatggtgatatcgcggacttcctcaatatcgaagggagccagacgtgcaccgcagctcaccagaatcgactttaaggtcttgcccgccgccagcttgaacttggcatattggcggacagcaaagtggttcggttttttctttttcagagcttcaaacatctgatccactggattctgaaaggtttcatcatcctcgcgcacttccatcgcgttcagaaattcaatcagcgttgcaaagttctgctcttccagcggtgcctcataatggatataaccaatcaaagcacaatacagcaaggtctctgccttcgtccagaattcgtcaccggccttgccgtcccctttagtgttggcaatgagggttgtggtcagcttcaaaatatccttttcgctgtgaatatacgcgaagggattataatgcatcgactttctgaaattgatagtattgaaaatccggatactgtatccgttcttcaaaagggcttggccgcagtcgattacgatatcacctttcgggtcagtgaccacgtaggaactgtgacattgtaaaaggttgggtttaagccaaaatctcgtcttaccgctgccggaaccgccgaccacaagcacatttttgtttctggcatttgccggattcttcgggcgattgcccatcatcagccgctccgtccgggtcagaatcacattgtttgcaaacactggatcttcaaacggttcgatgtctttctgcgtaccccatgaagcgttttgtcaagtgcttttttgagttattgacgcaaattatcgtgaaagtgcgaaagtgcaaagtgcaaagggtctgcgttttgcactttcagcttgcgggttcgggtggctgcttcttcttgatgaagttgtaccattgaccgccgacacgccttgcgcctaaaatgccgcccatgttgcgcttggcgttctgtaccgtcctctcggatattccggcttcggctgcggcttttacaatgtcctcactggcaagctctttcccgtctgcaagtaggtcaagtatcagcctttcggcttgctcggtcttggtggcggtgttgccgcccgcgccggacagcagctcgtcggcggtgatgtcgtattcgcctatccactcaaagcccgtttccgggtcaaggcaaaaggcaacgggcttgccctccggcgcaagggaagatttgtcatggacgattacccgcacattcggttctcgcttcacgcgcccgatcagcaggacgctccttgctgcggcgcggaagtcgatagaacctaagccccggtatgcgctctgccctccggcagctttgttgagatgtccgataaggataacggcgcacccggtacgctcggcaacatcggcaaggcggcggaacatggggcgcacttcatttgcccggttcatgtcggttttttcgcccatgtacgcctgtatggggtcaaggataatcagacgcgctccgttctgcgtgattgccttttctatgcgctcatcggagagggtaagctcccgcttggcttcatcaatcacaagcacccggtcaaggtctgcggcggcttctatcaggcgtggcttgacggtatcgcccagcccgtcctcggcggtctggtaaattacttggaatggcggcaagggcttcattcccggcagcgttcccccggtggtgcaggcggcggcaaggcgtagggcaaaagtggtcttgccctcgccgggattgccctgcacaatggttactttcccaaagggaatatacggctcccatagccattcaacggtctgtgtgtcaacctcgctcatgcggataatctcaacggtttcttcctgcggcggctctttcaagccgtagattgcttcccgcaaatacttcccgtctgtgatttctgcccggtgctgcaatacctcgttccagtccttgaaaagagggataagccgatggacggtcaagccctccggcacaagctctgcaaggcggctgcaagcgtcgtttccggcttcgtcgctgtcaaggcagaggtacacggtcttgatgttcggacggtcagagagaaagcgcaacagggctttttctcccacgccgcccaacgccagatagctttgcttctgccagtcctttttgaacaggcagaggaaagataagaggtctatcggggcttcaaagacaaacaacctttcgtcctcgccacggtagcagaagttaaaggctttgtcgctgcctttcacatcaagccgaaaactcccggctgtgccgcgctgatgggcgtatcgcggtatgccgctttcatctctgccgacgaatacggcgttgtgatgggcggcttcctcgtaaatatcgccgctggaaatgaaaaagcccgtcacatcttcatcaatgcggcgggcttcggtaagataccttttcacttgttcggcggtggggctgcggggcggcaatcggaagtcggagaggggcgcgaggcttggtctgtccggcggtggggcggctcctttttcgcctgtcagcagttcaacggcttcggtgaagctcttgccgaaaaactccatgacaaaatcaacggggccgccacctttgctttggctgtgcctgtaccatttgtttccccggatagtcaagctgtcgtgccgcttccagcggtattcatttccggcacgggtaagctgctcgccctgtgattgcaggaaagaaataaggtcggcttggttggcgcggtctatctgttcttgggtgtaatacatggctgatacctctctttctgtggttgaattgttcatagttttgatgtagaatgaaaccgaaaaatcggaagttagtgaggtgctggattgtgaatgaaagagaaaaaaatattcacttatggtttgaaatgtggcttacaaaacaggatttaggtattgataatatttttgcagaagatgtaatttatactgaaagttggggtccaaaatataataaccgtcaaatcgtaaaacactggtttcaggaatggaatactcgtggcaaagtcgttgcttgggaaatcaaacaatttttccacaaaggaaatcagacgattgtggagtggtatttcaaaaatgaaatgaacaatgggagcatagaggaatttgatggaatttccctggttgaatggacaaaggataataaaataaaatcattgaaagagtttggctgcaatttgaataattataatccttatgagcatagtgacctgcccgaatttagggacgaaagagcaagttggttttaatattaggaatcaatagcgtccattttatcggaaaacatttaggacggacaggcaaaaccgcttgcccgtcctttcctttatcgctcctgttcatgccgcttggtgcggctctgcgtctgctccggctgatcggcgcggagtgcaatatccacgcacctgcggattttttgaagctcggcaacctcggcgcgggtatctttcagtttggtataatcgctgtccctctgcgttttgaggtcagcatattcctgttcccattccgcaataggtaaggtctttgttcctttcggcagatttgcatggagatagcggcttgctgcgttccatagggtcagctcggcgcggtgggcttcctcgtacttgtcgcgcttgtttgtccagccgttttgcagctttttcagttcatcgtgaatgggcttgtactctgtgtagttcttcccgtattcaattagcttttgcagcttcttcatgcgttcctcggcggttttcattccctcccggattgaataggctttatcgctgacagaggaaagggctgcgtccagctcatcaagattagagataccatgctcggaaagatagttgaccgccgccgctatggttttcagttcatcggctgtgtgctgttgttgccaacgctgcgaatacttccggctcttttctctctgaacgctcaaatacttcatcaacagatttgcaaggccgggggattgcggcggctgcttcggggcggtttcccacgctttgaacaggtcggcaatccactctttgagcttgctaacctgcgcccggatttctcggataaggcggtttgccttttggatatttcggtttaattcgcctttctcggtggcgatacctttcttctccatctggcaagctgccacgcccatgtggacggtgggtatctcgtctatgccgcgctcggcgttgctgcggtggtcgatacgctccgggcttccgtttctctccaaaaagtcgttggtaaagtcagcccacgccttgcgccacaagagggtgttgtccttgtcgttccagcctgtaaggtcaaccttgtgggttttgtatctgccgcttggcaagcggatacgctcgccgttttcgtcaaggtcatattcctttttggacttcgctgaccatgtaccgcgctcgtcaagtggtcgcatagtcagcatgatatgacaatggggattgccgctgtcggtgtcgtgaattgcaaaatccacacacattcctctggaaacaaattgagaggaacagtattcgcggacaagccggatctgttcctctctggataactcaatggggagtgctgcgtcaatctctctggcaagctgggcattcccggctttctcgtaaagctccacgctgttccatagggtagcgcggtcagagaaagggggcggggcatggggcggcagcatgatttcggtatgcacaacgccgcctttgcgggtgtagtcatgggtcattccgtcccattcgtttgtcagcttttcgccgcttcggtaggcggctgcggcaacggctgatttgccttttccccggctcacaatgccgatgttccaatggtaaatggctatgggtatcacctcccggataggataataaaacccacaaaaatggtacagacgccaacggcgggtgtactgtttttgcgggtgtgcagggatagccgcgaagcggcgcaaggggtgcagccccttgttgcggcaaagccgccaatcggagcgcggggaaagttctctgtgcggagataagccctcggcagagcgcacacgcccgcaagggtgtataagtgcgcccttagttcctaagggattttcagcttgtcgctccctcggctcgttttttcagatattctcgcgctggttcactcgtcaaggcaagccggagaagcgctgtggcttcctcgtcggtcatgttctttgcttccggcacaatgctttcaaagactgcgccccggacgataaggcggtggctgcgcgttctgcgttcctctttggataacttttgccgcaataccttttcccggttttcaagctgccggagtttcttctttccgtcctcaatctcggcttgcagctcctcgcgggttttctctcttggctttgtcatggggggctcctttctgaccgtcggcataaaaatagagcagccgttttctgtacgaaaatagctgctcctatcccaaatggctattgaactatttacggctattcgccgtgtcctttaataactgatgtagtgtactcttttgcattgattattgctccctgcttgcatttggcgcaatacagggggaaactttcaagcacagtatcggggcgcattttaattcggtttttgttgttggaaatcgggtatagcacccatttttccttttcccatacgccacctttttccgtttaagatatagcattattctccattccgaaaatcaatatgaaagcaataatgaatatagataacaatattttaactgtcaatatcaattttttcgttttgccaaaagctgcaacagcagcacatacaatggctaagcaattcattgctactcttaaaggatagttatagctaaaaacacttccactcataaatgtgccagatacaatagatagctggcttatcaaaaaaatagaaatagaaaggcagtaaagcacaatgctaattagaagattgcgtttcccctcaatgatttttttcattataacaccccctgttaagacgcttcttcttgtttgatttctctttgttgcagctaactacagtcagcgctaaggcaagagcgaaaacaaatgctatcaattcattcatgttgaagcctcctttcgcggttcaaaaaatacatataactttccaatatgattataccatgcaaggcacgaacttttcaattcctgtctccatacaaatgtgtaatttttctatgaacgccgtactttttcgccgcttcgcttgccgccctgcggcgtttctcgctgtatggggcggtcagacggaaagagaaacgcccctttgcaatatcaaactccatgcagcccgtgtccgggtctgcgtcggtctggcggcactggtcggggtgctgtccggcgtaggcggcaagccgcttctttaagtcggtgttgtgggtgcggatatggatcagcgggtctttctcgtcaaaccaaatatcggtggtcttttcctgcttcgtaagccctgttctcataaattctcctttctgcgcccctgttacgcaataggggcatttttcgggtgtttttcttggctcttgacttggggaaaatgaggattttcaaatagaaaccgcccggacagggaatggttcgtcagggcggctgttatcgcaagatttctgttttttccggctcttgaccgtcagacgcggataaacgcgaactgtcggcaagcaccagtttgagcagcttgtcgcggaatgtttctgtgctgctgtgattgaaaaataactccgcaacaatggtctgcccgttcctccgggtcgtgatgatactgtcgggggtctgttctgccataggcggctcctttctttgggcgcaaaagagggatttcccgtagttcggaaaatccctcttggttgacggttattctgctttactgtgtgggctgtgcggcggcagcctgcgcctttctccttgcccggtattcccgcgctttcatgcggtcatactcccgctgcttttcaaggtttcgcgcccggtactcccttgaatactgccggtggtaggcgcggctcttttcctttttggcttcttcgatttcctcccgcatttgccggatttcctgctcggtcggttctgcaagctgtgtcacttcattctcaaacttgccgatataattgaaatatatgctgatgtgctggattgcgtatctcgcccttttctggtcgcgctcatgcacttcaatccggctgataaactcgttgagaatggcgggggtaagctcggtaaaggcagcatggcgttccgtcagcttcaaaaacttctgcgcccgtcctcccgcgttctcgtaagcggatagctgctcttggagcgtggcaagctccgctttcagcgcgtagtattcttccgaatacttctgcgacatctgctcatagcggtcttgcgggatcgtgccgagggcgttgtcctcgtagagcttattcagcaccttgtcaatctgttcaaggcgcgtcgtgatttgcggaatacgcttttgctgtttcttggtctggtcggtctgctgcatggcaaggttctttttcactaatgcttcaaactccgcccggttgctgatagaatagtcctcgattttcttcagcacttccgcgatggtctgcatgagcaaatccgcgtcaatgatgtgtggggaatggcatttggggttcttggctttccccttgtggtactcgctgcaataggcaacatggcgcttgccgccattccggtaatctatacgaatgtgcatttttgcgccgcagtctttacagaaaagcaagccggacagagggtggatttccccgtccccgttggggcgtctgacgggtgcgttttccaaaatccgctgtacggtttcaaaatcgctgcggctgataatcggctcatgcacattttctgtgatgtgccactggctccggtctacatagtggttatgtttatcccggaaatgctttgtggtcttgaagttgactacatcgccgcaatactcctgccgtgtgaggatattggtcaaggtggctttgttccacttgcagcggttatcctcgttgagcgtcttatttttacaggttccccgcccgcggtctttcatgtagaaagtgggggttgggatttgctcctgtgtcagatatacggcgatttggttgcggttcttcccgccgataaacagacggaaaatcaaacggacaacctcggcggcttcttcgtcgattatccaaaaatccttgttgtccgggtctttgacatagccgtaaggggcttcggtgacaatcggctttccgctcatgcctttggtcttaatgcccgttttcactttcttgctgatgtcctttgcgtaccactccgacatgatgttgataaagggcgcaaactccaatgtgtcgggcttctcgctgtcaatgccgttgttgaccgcgataaagcgcacattgttccgtctgaatatctccatcgcgttgccgacttggagatagtcgcgcccccagcgggtaaggtctttcataatgcagacaccgattttcccgttttccacatcgtccatcatgcgggagtaggcggaacggtcaaaaaatctgccgctttcgtcatcgtcgatgtagtgccggatattggttaggtgctgccctctggcatagttctccaaaaatattttttggttctgtatgctgttgctctcgccgccgtccctgtcctcgtcgcccacggaaaggcgggagtaaagggctgtaattttgctataatcagtcatgtgcataacctcctgtgcgtccatgtatgtgtcatttacacttaaaattatgcactccaccgggcagagccatactccataccatgacgatatttcttggcatttttgcctttcagatacacagcaagccgcagacccgctccgcagcacacaccaatcagcaaatccagcggatgcagacttggcatcgggttggaaaatgctgcacccagggcagaaagaaagccgaggagcttttcagacatgtctgcgccctcggcaattctccacgcttctcccagattggtacatacaagaccggcaatgaagtacggcaggttcaggatcagcagcttcttggtcttattactcatagatcacgctcctgacttttgtgacgaaccttatccggcagaattgcagccaccagttctttgagcttgttaagctgctccaaaacactcggtttttcctttgctttcagctttcggttggtgaattcctcaaaagcggaagtcagtgcatccgcatctttcgccttaaagaacaccgtgtacttgggtggaatcacattttggtctttcgtaatggcataatccacaccatatttccgcgccacctgttcaaagcctttcaaatctgttttctcaatggggatactgctgactccctgattctgaccgatcagttctttgatgctctgctttccaatcggcagctgcgacgttttctgagcaaccttcgcctgatgatgccgtttccaggcattatagccattcacgatggtgcgaaaggtcagtttcgtggtgctgattgccagattgactgtacgattttcaacttcttcctgcatgaatatccgcctccttccttacaaactatccctgtccggtgccggtttgctcttttcctgggactttgcagccttttcctccatcttcttcaccatgtcatccgggaccggaattgccatgatgctgcgacccatacgaacgaacatctggggctgatggaactgttcctcaaatttctgcatctgctccgatgtcaaagaaccaaagtcatcctctgtcagccctaccaccagaaaatcaccggcataaatgtcctgcatatccccgtcttcggtgtaaatcgcacggttcagcggcaaaccattgattttaccggattcattcagaataatggccactgcatcctcaaatggataggttacttcaatatcgccgccgaccatagcctgcaaatcttccagctccgtgccaacactgatttttttcgggtaggcattgggctgtaccagcagcacattcattgtcctggtctctgccagttcatgttctcccacggtcttgaagtccacaccggtgaaatcgccggaatccagaacatagtcctgattgttccacgcctgcgtcaccatgcgttccgcgtcttcctgtgaggcagcttccacagaaacctttctctggagagtttccgtaatctccacatcgaatttcttcataggcacctccttagatcaggcgcagtgccggaaccaactcaccgccaatggaaaccaccgtcaggttttcgttcacatagtcgatggtgcgttccaacgtaaacagattgatgctgcattcgttgccgttctggtcgatttccgaaacttccgcagctcccagcagatagcgggttctgtctgtctcgatcacatcgctcttatcataatgaagaagcagctccccatctgccaccagatcagcctccatctcatcgtaaacatcctcaaagatgtctcgactgccatcctcggtcaggagttcgccgccagcccccggcaggatcaccatcacaatgcgctccttcgggtgatcttcacggattgcctccagcatcagccagttatgaagcatcgcaatggacttctcaaacatgggatcatccatcggattgggctgcgatgcaccgtgcgggcagttcttgcaatccatgctgcacactgcgttgttctgattcttcttaaagttcatcatcataaaaatctccttctcatcgttccatatctcgttgtttacttcgctgccatttttccagcagccggataatcgtgtcctgcatctgcttcggcgtataggatttcgggaaatacttccgaagaacctcgtttttaatcgtcacatggtcaagctcatcctttttgatttcattcatcacttcacacatggcatccaacgtgcagccgccctcctgtgagagcttcttcagccgctgtgtttgcgacagggatggagatgcctgtgcatagtccattgcctccagaaattccttctgttcagacggtttcaggtaagacaactccaccgccggattaaaggcgattttcttctcatccaccatgtccagaatttctggaatcaggttggtaaggcggataaaacgctgaacttgcgttttactttcattcgcatcatcagctaactggttcacagcccacgacttctgaccaacttggtcagaagttaaatctccgcgttgtccctgatgtttcatcgcttccaacttcatcttgtaggaaaacgctctctcgctgggaaggatattttcccgctgcaagttgctatccaccataaagatgattgccgcatcatcgtccatttccttaacgatgaccggcacggtctccaaacctgccagctgtgccgcatgaagcctgcggtgtcccgaaagaatttcaaatccgccttccgggtcaggccggacaatcagcggggataccactccaatctgcctgatactctccacggtctgttccatcagctcatcgtccagcaccttaaagggatgcccttcaaagggatgcaggtcagaaagcggcatctccgtccgcttctccttagccgcagcgccggcagctgagccactgcggttttctgttgtaatactggtttttgcttttgccattcagcttcttaacctccttccagcggtgatagatgtcattcttacctgcgaaaaacgccttttttgccttgcacttcatagatcaagtacctccttaacgacctgctgtttttcttttccaatgctctttctgcggtcctctccgctgattcgcaccggcgtacacatttccagaatcctgctgtaaatccgggcgtatgccacatcctgcggattgcggatttctgcaattttcagattggttgtgataatgaccggaagcccggacttataccgctcatcaatgacagcgtagacctgctccagcgcatattcggtgctgcgctcaattcccagatcatccagaatcaacaaagaatagttggaaaacgaagcgatataccggtatcgctcttccgaatacatggcacccatctggttcaggatcttggagaagttcgtcatcaaaaccggaatgccctgctccagcagcgcattggcaatacatgccgccacaaaggactttccggttccgacatctccccataacaaaaggccaaggttttcagccttgacctttttccactgctccacatagcgttttgccatttggatatccttgttgtcttctgcaacggcaaaattccattccagaagatgcttttcctgaattcccgttgctttcagctgcctgattttacgctgacgctccaccagctcatcctgacgtttcttttccgccatcgcttcctgctggcatctgcaaaggcagggaacaatcttgtctctgccccagagctttaccctgcactgcaccggcgtatggcagcttcggcaatacagcagtccgtcctcgccctggtattcccgctctccgggttcttttggcgtaaagagcgaatccaacgccgcattcaaaatttcaggcaccatgtcgctcataggctgtctccttcctcaaatgtgtagtctgccgggttatacttcggcttttctctctttgcccagctccggattgtggcaaggtgatttttgtagctcctgccggtggaggccatatactcagagagccgttcaacccgcatctgataatctcttgggaactcctgccggagcttactgtattccgtgtcagaaagaaggacattttcgtatgagccataccggtgctggatttccttcttctctcttttattgattgtttcagtacttgttctattagtacttaattgcgcgggattttccgtaaccggtgtgtccgtatccggatttaccgtatacggcttttccgtacacggtgattccgaacacggctttttccttggcatctcataaatcacatactcggctctgcccatccgaccgttactctcacgctgctggttcctttccagatacccaagacgctccagctcttttagagccgtaagcaccccatctacgccatccggcgtaatcgaagataacccccgtaccgaatagttccatgtgtccggcaaactgagcagcatagagagaagtcctttccctttcaggctgagaccctgatcgcgcaggtggtaattgcacatcgttgtgtaattgctgtttttctcaaccctgaataccggcatggtgctcaccatcctttttcgcaggctccgtttttttcttcggacatttgcgcgaacgatcttcgctgtcctcccgtcgatggtatttgccggtatcctgcatcatgcgttcaaacgcctgaaggcgtccctctgtaaaaagcgtcattcgatcacaccccatttcttaaacaacttgaagagatgattctttcccttgcaggtcactctcgtctgctgcaccagttttccgcttctgccgtagcaatcccggacaataaaatagccccttgcagatttgtctgcaaaaggcatcagccagccgcttggactgcggtacagatagcggtgatccagtaagagagctactgccgtcttctctgggattccgatttccttacagaaattccggatgcaggtgcaatcttccgaatttacaaaggtgtcgaagtagtctgccttgggctgtgccgcatccagctgtttgcggataccctcaagctgctctctctcggctacaagctcctgtgccagtgtgtagatgacctccggatgctgaatcacctgatccaaaatggaatcgctcatatacacaccatgcttgcgaatggaaggaagaacttcatcaaacacccagtgttcaaatcgttctgccgatggcagcttgctgtgaacgatcagccggtaaacatcgccttctgtgataaaggagatttcaacgacctgctctccagcatctccatactgattcaccttctgaacgaccccctcgcgtttcgttagggggcctctgcaatggcgtttcactgcggcgtagggattcacataccccaacgctttcgccacatcgcttgcacagaagaaggtcttgcccgcctcttgcaacacgcggatcgaaccaaactccttgttctcaaacacctccatcatctgccttgactgtccgccatgactgcccacatcggtgtcatgggtcttctgattgaaatccgtcatacctgttacctcctgctcaaatttgtctcgccggatttcgggcgaaaaaaatagagcctcgacccattctcgttttcaaagaatgagccaaggctctatgtaacaggatacctgatattaaatttttgcagaattcgtcagaactcgccaaacgaacctgacactgtttttcattccgtttcagccggatttttgccgaaaatctgtcaaggatatggggctaatttcccctccaaaatggccttctgtaaacccattttcccacccattaggctcaaaaataggccgtaaacccatggtaaacccatcaaaatgggttaatttgaagtcaaatttcctcaaattccaccatcggaatcaggcgatttcaggcatagaaaaagcccggaaatggcgtatttccgggcttttttagcattattaagctgtagattagcgcttgctgaactgcggagcgcgacgagcggctttgaggccgtactaaacatctctatggtgcgtttttccttgatattacgggctttttcgcattttctgttgtcggttgtcctattcctcaaccatagaaatcggtgatttttcatcgaaattctcctggttcaaagcagcattcactacctcgaaaagttcctctggtttattatacttgaccctcgcgtaaatgtccatagttgtcttactattctcatgccctgccagatactgaactgtcttagggtcaacgcccgcatagagcagattcgtgatgtaggtatgccgcaacaagtgcggtgttacatcgaaattcagggtatagcgaatcttgggattgttcctctgcgttgttcctaatgtcggcttgacggtatatttaatgctctgtccattcacatatttatagtaggttctctcttttgcagaacgaacaactacatactgccaaactcttgtaaactgagaataggaaagcggctgtccctcgctgtcggcaatcacatactccgatatggaatttgcttttgcttcccgcagacagtccaccagacatttcggaatgggaatatcccttttagctgcttttgtctttaggacggtagaaatcaccggcctgttatgctctgcgcgccatgcacgtctcacagaaatatatggggtggattcatccaagaagacacagtcccattgcaatgcaagaatttcttcccgacgcaagccggaatacaaaccaatcataataaaaagatatggcggaagctctttcaccgtatccagcagaattgcaacctgttgatctgttaaggcgtctttctttttcgatgcttttccaccctttgctgaaattcctacacacggattatcggttatcagctgactgcgctctgccgaataaaacacacacttaatcagcatatttaccgtatcatacagtcctttcgatttttgagacagcggaacaagcgccagacgaatatcatccgcagtcacttcctccatatacatatctcccagagagttgatgacataattcttcatattctgtctgtatccttttatagtagccgtagacacctttgctgactgcatcagcagccatttctcacaatactcggcaaccgtcggatgctttcggtgaaagatgatctcatccacctgtctccgggcctccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcacctacttaatcaaagatacggattatgtaaaacaaagagcgagacatccttgcctcgctccagctttgtttcctactctttataattgttatgcctgtgctgcatcccactgggcaaatgcaccacccattgttcttaccagctcatccggtctgttgtatttgacctttgcgtaaatatccatcgtaattttactactctcatgtcccgccaggtattgaaccgttttcgggtccacggacgaatgaatcagattcgtaatgtatgtatgccgcagctgatgcggtgtcacttcaaaatccaaactgtaaatcactttgccgttatgtgctgccttttcaccgaggaccggcgtaaccgtgtgctttacacgctttccatcctcgtagcgataatagaaacgctccttgactgttcgggttacaatgtactgccaaagccgcttgaactgtgtgtaagacagcggatcgccctcccggttcggcaccacatattctgactgtgaattagcttttgtctctttcagacagtccgccaggcaaaccggcaacggaatatttcgatgcgcggctttcgttttcagctcatccagaatcaccggtctgttattttccgtgtgccatgccctgcgtaccgttaaataagggcaatccacatccagatatacagaatcccattttagggcaagaatttcttctcgccgcaatcctgcatacagccctaacatgacaaatacatacggcggaagtccctgaatggcatccagcagtctggtggcctgttcatccgtcaatgcagctttgtccttctgcggaacgcctccacctttggccgtaaggtaaatcgttgggttgttatcaataatcttactttcctttgctgcacggaaaatggatttatacaggataaccactgacttatataccgaagcggacttctcggaaacaggaacaagtgcaagctgaatgtcatccagtgtcacatctgccatccgcatctgtcccagttcttttataatgtgccgtctgacctttgaggtataatctatcagcgtggttgccctcacatgaaccgactgcatcaaaagccatttttcacagtagtctgcaaccgtcggggatttccgacagaatgtatcgttgtcgatctgctctaatgctcccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgccacctcctaaaaatatactccagcgctgtatctatgttttatcagaccattccgtttccagcaaggatacggatcgactcacactccagctctgcgaggtctacgataagttgcgttcttttctgccggctttgctctgtgggtgcattttgcgatatactcctgaaggcccgctgaagtaaaatacacacagccattctgcacatattgcacataagaaataagaccattgttacgggccgcgtccagcgttgcaatgctgatacctaaaatttctgctgcttcttttcgtgtaataagtttttccataaagcatatttcctccaatctgtcaagtttgtcatcgtgtttgttcaaagccacatgaatacgctggcagccgaaactgccagcgcatggtatctgattttgaacaggaagctgcaaacgcttcctatttataaaactcagctttcgtcacatttgccacgccccctgacgatgggaacacaacaggtctccgctggcgcggctgtcataactccgcagcatcgttcgtatcgtgtgccgcagggttccccccaagtctttggcgggccgtgaggaagtatctttagcccccatgcagtcatcgcgccgaatctgccacaatccgttttatgaaatcgtagatcgctccgaagcagttctttcatcacctccctgactgctccatcttcgcggcgtttcatattcgctcgtacatgggttatgtacctgttgtgctgtctattcgattgtcaatgtgcagatgaaggaggaaaacttgtccttcttattaacactgacaaaaaaggcaaaaaacaggcgcatcaaatgaaattttatcaaaaatattttacaagctgctttaatccacggcggatactgtctcggacacggcttgggtctacaccttctacttcggcaatttcatttaccgccattcccagatagtatcgggcataaattcgctttgcctgtttctccggcagcttcatcacagcggcatagacctgctcctgaaactgtttttcctccagaagcatctccggtgtttgcggcttcaatagcaccgcattttcaatgccattctcgcaatccagagaatactgtgctttataacgatacatctttcgctcatacgcagcctccgcacgttcagctgctcgaatagtctccattacttcctctgtcacatctacaaaaaagtctgttgtataaatatcaggataaagttcccgaaggttaattttcttcattatgtacctccatttcgattcacgggtgattgacgggtgaatcgaatggaggcggagaccgacaccggcagacaaccgggtcatctccgaaaaaatggcaacaaaaaacgccagatttccgtgagggaaaactggcgcaccaagaacagccattattatactgaattacatggaacgataatgccgatacaatgttatacttgcccggaggaggagcaatgctttttttaactgatgtagatcatgtgagctttgaaaaagcaaacgagacacggcaaaataacctccaatcggctaccgtgtccctgcaagtcgtcataggtttgtgtaaacgcaaagaaacggcggctctgaaaatcaaagccgccgtttcaaatgggcgtgtcaaattgtctgctctacgacggctttttttcttttgccgtcgtccggcagattttctcttttaaggaaatgtttatgaagttctatgatacagcaagatccaataagtctactcactttttattgctgataaaatactcgcttttttcaattccattttggaatacatcgaaaaaacaaggtatatcaccaataatacacaaatcagtgccaacaggaaaaaccacggtaatttcaacgtaatacaatgattgatggcatctaatcgtctgcatacaattacactaaaaatacttccgcatataagagatattgccaatgaacctccgaggtaaattccaatctccctattcagcattgctttcaactgttttcgcgttaccccaacagcttccaacagaccgaattcacgctttctattctgaaaatcaaccataagcatattcataaggctgatacttccaaagacgaacagaatagcagaagtcatatacagagcatgtatagatgcactgtatcgatactgaatatttttaatcgtttgttcaatcgtatttacttctatttttccatttttatccgcaatcttctgaactgcggccaaaacttcatcaaaacgtccctctgaatttttaactgccagaatccccgtctgttccgttatccctgtcagtttctttgctgtgtcataagccataatgaagtagggacttccgggaacaaccgggctatcctccattaaatcagacctattgtatgtgcctacaacaacggcttccacatcaaaggttctaccatcaaaagctctgccctcaatcttcaaagtatcgccaacttgtgctatatcttctgcaaccaatattccatttttctcaaccatatcgtcgtaatctgctgttccggaggataacaccgcctgcttttcttctgtctgttcccgatttaaggttggaaagaaacttgaaatgctcgtgatagaaccacttccgcccgaaaaagtagctgtcatataaacgctgtcaaatgcggtgattttttctatcccatctaccttttctaattcctgcatcaatgcctgatcttcaagtggattttcttccagttgcaattttgcgcttccgtatggctccgcttcgttatcgaaagagctacccactgtatttcttatttgtataagaatgttaccggcaggataatatttgaaacttgcctgttttgccggatcaatagaaccagcaaccgtagaagtaaccagtaaaagagccccgcttactccaagcattaaaagcgttaggactgccttttgtttgtttctttgtatatttattttcgccagattaaacggcgtaagtttccgatgcagttttgagctgctttttgcctttccagcatacgcaaggtatttagcaccctctaccggggaagtattcattgctactcggacaggcttaaaaatggcaatatttactattacaaaggctactgcggcaatcaatacagcataaataactgttgtttttagccggaatccatcaggacagccaataaatccaatcagtacaccaatgacaagccccaaaggaatgccagctaaggcatataaacgtccctctttacttgccatccgtttaatctgtcttttcgtcatgccaactgtccgcagttgcccaaacatctgaacattttttacaatctttgtgtaaaaaacaccatagacaatcgttgccgccaaaatagccgtcaacgccgccagtagtggtactggaatcggaatacctgatgttatcacacccgacataacagcagaataatctgtaagcattacctgttcctcgacaatgcctgtattttgtattgctttaccggcaaaatcaagaatagccgtggagcttatagcgtctgtattcaaccgcgtatatgctgtaacctgaaaagaatcttttgccaaatctcgggcaagctctttactaacataaataaaatatccgttgctttctttcgtattattcaaaacacctgaaagtgtatattctgcttcctgtcctgttccagtcaggtcaatagaaattgaatcgccagcctgataggattttcctaaaaaatcaaggtagttctgggggagcataatctcatccgctttctgcggcacacttccctgaaaagttttttcttcctgatgtaaaaaataatcttcatttccataagcaacagtgattgttttattttcaacataaaataaacctagagcggaatattcgccaacccacataatattttcgttttgacgcaattgagccgtttgttcgtccgtaactcccaaaatgccaatctgcgctttatttctctgtgtgttcttgaatttctcttgtgtgcctgttgatattaggagaatcgaaaaaaccatacagacagagatggcgattgtcaaaagcagaaatgccttgtttctcttatctgcttgcatactcctacctgccaatttttttacaatggcacttgtatcattctcaaaaggccatgtcatagtctgccacctccttattccacaatcttgccgtcctcaatgcggataatccgatctgcaaggcgggcaatgtcgttgttgtgggtaatcattacaacggtttgccggaactccgcactggtacgcttgataagccccagcacctcggcgcttgtcttgctgtcaaggttgccggtcggctcgtcggccagcacgatagccggtttggtaattagggcgcgggcaatcgccacacgctgctgctggccgccggaaagattgttcggcatatttttcagtttatcttccagtcccagcaggtgaacgatctcgtccaaaaacttctgatccactgcgtccccgtccagctccaccggcaggacaatgttctcatatacattcaggatgggaacaaggttatagttctggaagataaagccgatgttgcggcggcggaagatggtaagctgttcgtcgttcattttcgacaactctttgtcccggacaatcacattgccggaagtaggggtgtccagcccgcccatcatgtgaagcagggtggacttgccgctgccggaggttcccacaacggccacaaactcgccttcctccacggagaagttcacgccatctagggcgcgggtaatgttcggctctgtgccgtaatactttttcaggtcgatagtctgtaaaatgctcatactcaaaactcctttcaaggcttcctgcctgttgataagggtattgtaaaacccaaatgtccgcgaaatgttacagcggcaaggaaaattcattgaaaatcggggtgaaatgttacaacgatcggacatttcaaaaaatttacggcgggcagccggaaatggccgtccgccgcattctattttgtcggcagcataatggaaatttccgaacccttgcccggctccgaaactactttgatatagccgccctgccgcgttacgatctcgcgggccagatacaggccaatgcccacgccctgctgttcgtgtacttcttcctcacgataaaagcgccggaatatggcggcctgattgctttcggaaatgcccttgccggtgtcggctactttgatttccacatacatttcccacagcaccaccgacacagcgattttcccgcctgccggggtgtacttcaccgcattgtccaacaggttaaaaagggcttcggatgtccacttgctgtcatggaaaacggccaaatcctccgggcagtccacggacacggcgatttgttttttctccgctgcatacacgatcccactcatggcctgggccacggtatcaaagaggcggcccggtttcttatccaactgaatgacacctgtttccagacgggaggttttcacaagggcttgaaagagaaagtccagcttatccgtttgggttcgaataccccggatgaaatcggtgcgctccgcttcggccataggcttttccagcagagtgtccgctgccattttcagattgctcaccggcgttttcacctgatgggaaatatccgatacaagggtctgtaactcctgccgctcctcgtccacccggcggcggttctcctgcatgatttggtaaagccttgccatccggtgtccaattctggcaagctgggtttcgctgtcctccgggcgctggggcgcttcattcccggcaatcatgtggtctaaagtctggcacaggtcagcggtaaactgtgacaaccgttttccaaacgcctgtgtcagtacaaaaatccccacaagagcgcacagcagcagcgccccgcccgtcagcaacgccgccgtctgttttgtcacaagaaaaagggctatggtgatcccggacatggagaaggcaagccctattgccacccggccaaacagccgctttaccgataggttttgaaacttcattttgcctcgcctcccgtccattgatatcccatgccgtaaacggtcttgatgtatggcgcgccgccgtcggattcaatcttgctgcgaatccggctgatagaagttgtcagggtgtgttcgtccacaaacctttcgtctatatcccacagcttttccaaaagctgcccacgtgtcagcacttgccggggatttttacgaaataggttcagcattttgtactccatcggggatagggtcaggggcttgccgtttaaggaagccgtctgctccgagaagtccagaaacagccgcccgtcgtcgtaaatgtccttggccggtttgtggtgttccagcatggcgaacatggctttgatttttcgctgcaaggccccgattacaaagggctttgtgatgtagtccaccgcgcccacctcatagccccgtatctggtcgctctcctgatcgttggcggtcagaaaaattacgatggtgtccgggtgctggggctttatcagcttgcacagctcaaaaccgttcccgtccggcaggttgatatccagcagcaccagatcaaattcccgctggcggatagcttcggctgcggttctggcatttagggcagaagtcacgccgtagccatctgcggtcaggttataggccaacatcttattcaaaaaactgtcgtcctcgacaattaaaatctgcttcatatcctcacttccttttctttttgcaaatagtataacaggcaaatgtccgcgaaatgttacagcggacagattttttcaaaaaatatccctctctattataatttgatccagttagtggtacaaggatggcattcaatatttacagctatattaaataagaaaaagtctcctgctttttcactcaaagataactctgtaaaatacagctctaaaactaccacaataaataaagcgcaaagtcttctgtatcaagatgactttcgatatattcaatggcgttacttaaattttttaaccattccattttctaacctccttgcgaatatcataactcatataaaatttttattcctctctttttatgcactcttttgtaaactaaccataccttaataaaaatctatttgcaatgtttaacttcggtataatcattcctattcgtcggcacaataaggttattcctttgtgtaaaccggaacgatacaatattcttgaggtgaacgattatgccgattgatgatttaactgctttagggcaaaaaatgcgggaagcccgaaagaataaagaactgacacagcaggaactttctgatctgagccatgtttctgtaaagcaaatcgccaatatcgaaaagggaaaaatgaatccttcctatttgattttaagagcattggcaaaggtcctgcacatctctttagatacgcttataaatccagatatttctctggaagatgaaggtgtcaatcagatgaaaatgctttattccagctgtccgccagaaatgcgtgacaccctgctgcatcacacccaggaaacggtgaaagaactgacagagttgtccgaaaaatttgaaacgaattgagccagtgagtgaaatttaacgattctctcactggtttttttcattttcggagaaaagaggcaagcaatgcctgtgttaatacacacaggcccgcagagaagaaaatccctttgtgattttcctctccgcttgcttgttgagggcagcgcccccaagcccctttgaacacagaatttcattctgtggctgcgcgttctgcgaacgcttttgaccaggaccagcttaccgctggccgtgatctttttccttttccacatcctgttctacctccattttcagcacccgatctacattggcctttgccgttaaaagctcccgcatttcctcacgggaatgccggtactcggcataggtctttttcttttcttccagcaattttgcgtactctgtctgtaactctttgacctttggcagcttcttgacgcccatctcatcaaaggcattcttagcagcctggtggagcagaatttcttcctcatgttcttcccggaatttcttagagtagcccgccttgcggtatgccacatagacctcacgggtctttgcataatttacgatgtgagtacgcagaacagcaatctctgccatgcgcttttcagccgctttgatctgcgccgaaagttcattgtgatgtgccgtggcagccgcagccttttcttccaaaaccgcatactccagcaggttatgctctgacaggtaattcatggtctgcgccatttgcttcagattgaaaaccttggcccatcgagcatagccagcaccttttcctgcctgcaattttgcctgaatgtccaccagcagattgaccttcggcggctctgcctgtgtgactgttttctttcgcggggtatgtgctttcttccctgagagaactgcccgcaaatcttccaatccatatccttcgcccagactgtccatacgggcggctttctcccaaccggggagcttcaagcgatatgatttccctcgttttgacacctcacagccggactcttgcagcagcttcagcaacgcctcaaagtcagcaggactttgtgataatgcgttgtcaatcgccacacgaagcagctctcggtgagagggctttgcctgatcgcccagccatttgttatagctctttccgtaaggtttcggattctctacaatggacagtccattctcaatacagatggtgtcacttagccggcgaaccgccttggtgctgccccaaaagtttcggaatttccggtcatattctaagctgaccgatgaccagataatgtgattatgaatgtgcgacttgtctatgtgagtgcagaccacaaaggcatgattccccttggtgaatcgcttggcaaattccacacccagcctgtttgcttcttccggggtaatctcaccgggacggaaggactggcgcacatgataggcgatcacatcatctgcgccgcgcacccgtccggtagcggcaatgtactgccgctttgccagaagaaactctgcatccgcagtccggctgtcacacgcatagccggtaatgagtttgccgttatctgttttctgtggatttgctacatagtcgatgatgtcactgatcgcccgactctctgtgcggcctttgccgacatgaagcggcatgattcttgtagttgccataaaaagccctcctctcaaaatattttctctgaactctttgtgcctatcgttgaaataaactctccttatgggtataatataaagaaactaccattacctcaaaggagggattttatgatagaacagctcattgctgaagcaaccgaatgtgatttcaaagttgcacttgaaataaagaaacccaaaagctggttaaaaagtgtcagttccttttctaatggaatcggcggcactctgtttttcggaatctctgatgaccgggagcctatcggcttgtccgatgttcaaaaggatgctgaagcgatcagccgcttaatcaaagaacgtatcacaccattacctcagtttatcttaaaaccattacaggaagatggtaaaaatctattagctctggaggtttctcccggccgtagcaccccatattattacaaggcagacggcgtgatggaggcatatatccgtgttggaaatgaaagcgtaattgccccggattacattgtgaatgaactgatcttaaagggaaccaatcagtcctttgataccctaacaacagatgcggtaaaaaaggattacagctttacacttctggaagcaacctatctggaacggactggtctccgctttgagccatccgattatgtctccttcggtttggctgacaaaaatggggtcttgaccaatgccggaaagctcatgaccgatcagcacacagtctataactcccgtatgttctgtacccggtggaatggcttggaaaaaggctctatctttgatgatgcattggacgataaagaatacgaaggaaatctgatttatctactgaaaagcggcagtgaatttattcgcaataattccaaagttcgttttgtcaaagaggcacagtatcgtgtagacaagccggattatgctgaacgagctgtgacagaggctcttgtcaatgcgcttatccatcgtgattatattgtgcttggcagcgaaatccatattgatatgtttgatgatcgggtggaaatcacatctccaggcggtatgtttggcggcggctcaattcaggaatacgatatttacagtattcgttcgatgcgacgaaaccctgtgattgctgacctgttccaccgcatgaagtacatggaacgccgtggaagtggtctacgcaaaatcgtcagtgaaaccgaaaagctgcctggatacacagaggcatacaagcccgaattttcctcaacagcgacagatttcagagttattttgaaaaatgtgaattaccatcttagtcagaaagacttagtcagtgaccaagattgtgaccaagttagtgaccaagataaatcacgggacatcctacacgcagtcttggatttttgtataacagaaaaaagcaaacaagaaatttgctcgtttattggttatcgaaatctcacttattttacaagaaaatatttgaatcctctactggcaagtggccagcttaaaatgactattccagataagccaaacagtcgaaaacaaaaatatattacagttcgttctgaataaacagagaagcagggcattgggtctcatctcccattgtcctgcttcttttcattccaaattatattcacatcatttacccatacacccaatcctggatcgcaaatttcaaactctgcaccttgcccagcagccagattgcagccagcggcagccccatcgggctaatcaaaaatgccataaccagcaaaatcacaccattctgcggggaataggtaatcagcacagccacgccaagcagagcaattatcgtgctgagcagaccaagcaccaaaccggatatgtagatcagccccatgcagagccagacaaaaagtgtcaacaccaaaatgaccggtgcagttacgatcatcagcagacatttcaaaatcttcattccagttcctccctccaacgctccagatgccgtttgcacagggcatccgcttctctctcatcatcttctgtcacttcccgttttcctttggtcagttcaatctccagataagtccggtaatcatcggctaagaggtcgaacatttccttgggagtatggcacacctcgccagagcaatagtgaaaatcttggtcaaattcaactcttacacatccatggcggctgatataaacttctatggtctcgtctgcggtcaggtaatccgcaaaaatctccagcaccttttcaaaggtcagcatctgttttcactcctttgctacgcttcttattctactcatattatccggtacggacaggcaaaagacaaggatacaaacaaaaagaaaaagcggaggaaggtgcggcgaagaaatgccgttcctccctccgcaaatggagtatctatccctgttatgaaagtttggagagttgggtaaggatttccttcacaccctcccacagttgttcctgccgctgggatatatcctccaagtcagcattataaacccgcccggtctcatgcactttgcgagtcagctgattcaaattgttgctgcttcggcgcatcagggagaccaactccttcagctccggcagttccagcttgaccacataaccatccagcgccattttccgcagataagcgctcaaattctctgtcccgtattgatgcatcttttgatggatcagttccagttcttctgcggacacccaaaacaaaaccggcacatcccgcttgcgctttgccatggttatcgctccggctcccgttttttcggggcggcaggcttatgggcaggcggttcctgtttgagcttttgcaggacagaacttttctgctgttcttgagcgacttttcggaactgtctggtgaacaggtcggtcaaaccgggattgacctgatctaccaccagataggcacagtggtgggaagcgccgctgtcctccagcataggaatggtttttgcccatgctttattgtcctgagagatacgcccgtcatagttcttgcgctggatggtgttggcaagaataaactgtacccgttccgtcccgaacttttccagcacatctttgaccgccgcctccgtatccagccgattctctgcatagtgggcgctgatggtctgctcaatagcttctttgcaggtgctgttcgcctgatatgagaggttgtactgtgccatttccccatgctcggatgcataggcagctgaatggggatagaccggtgttgttcgcagttcctctttagccctgcacacatcatcagcacggttttcaatgctgtcccggatcacatccatatagccggtctccagcttttcaaaatagcggtacacatccgccaacggagatgaagattccaaaagtgcctgagcctgggtgtcggtcagctccagctcctccatcgccatcacaatatcctcacggacagtatattcataggtgtggtgcaggatttcttccgggggctggcttttcaaccagtccctatatttttcctgctcagtggtcatcttttcataaagagccgtattcagattattggtattcatgttatcgcacctcctcatgctgttttggtttcttgtctgtactgcggggcgtcgccggacgcttcaggctgtccagcaccgaagtccgtgtgcttttggcaacaacagcctcggcgtgtgcctgtccctttccgtcgatgttgagcaaagtatccagctccgccagacgggcatttttgcttcgcagttcttcttcataaaggaatggctttccgacttcctcctttgcggcagcctgctgctgatagaggttatccagctgggcctttgccgcctccagacgctggggcatctgggcgagagcattgtcgatacgggtgagatttccgcgcgggtctgtaccaagggttgccctgtgggtcatctggcctttcagcaggagcgtatattcctgtttccatgcggaaaattccacggacatagcataaccccggtagctgccaatctgcaccggatcggaggttttgacctccttgcaggcatccagaagtgctgcgccggcattctccttatcggtcagcagatcacctcggatttccataccagcaaaaccgtcctccgggtgcgggtgcgctgccaaaacctccaggtcagattcaaagcccatgataaaacctttgtacttttcaatttcctccgggaagtatttgagcaactggtcctccagacgatattgcttgctctggtggtcggctttcatcagcttcaggcgggatacctccacatccaaatccatacgctccttgatgcggggatctccggcgcacagggctttgatctcggcaaaggaaagcgccgtttcgtccacatcatcgcaggaacgcaccggcgatttagaagtcatgatctgactgatgaatttttgcttattctccaccgtctgccagaggtatgcgtcaaaggttccttcggtcacatagcggtacacatggacaagaggattctggttgccctggcgctcgatacggcccttgcgctgggcaaggtctcccggtctccacggacagtccaggtcatgaagtgccaccagacggtcctgcacattggtgcctgcgcccatcttggcggtgctgcccaaaaggacacgcacctgaccggtacggactttagagaacaactcctttttccgcacttcggtgttggcttcatggataaaagcgatctggtcggcaggcattccctgagcaatgagtttctgacgaatatcgtcatataccgtaaagaccggttcctgctccggcagaggcacagagccttccaatgcgtgaagcagtggattatccagcgtttttgccgccttgcttgcaggagcttttgcctgcggtgtagaaatgtcgcagaacaccagctgggtcagcttgtcagctttgccatcccgccagatctgcatgatgttgtccacgcactgattgacctttgtgccaggttcatccggcagcatctggttgacgattctctggtcaagccccaacttacggccatccgaggtaatcttgagcatattgtcctgggacgggtcaacggttccgctgtgtaccagcgatgcgcgctccgaaagggtcttgaccatttcctgctgatgttcggtaggctgcgccacgatgttgtggtattccacctccggggtgggcaggttcagttggtcggcggtcttgatgtccgccacttctttgaacaggttcatcagctccggcagattaaagaacttgctgaatctcgttcttgcccggtagccggtgccttccggtgccagctccaatgctgtgacggtctctccaaatcgggaagcccagcagtcgaagtgggtcatgttcagttcttgcaggcgttcatactgaagataacgctgcatggtgtaaagctcggtcatggagttgctgaccggggtgccggtggcaaaaatcacgccacggtttccggtaatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacgcccagctgctcgaaggttaccacatcgtcttttcgcccttcggcttgcagcttttccagtctggcttccagagactttctggtacgctccagctgcttgacagtaaaacgctcgccgccgctggcctgtacctctgcaatcccctcggtgatctcgtcgatctgctcatagagaagccgttcctgacgctcccggctgatggggatacgctcaaactggctgtgtcccatgatgatggcatcataatcacccgtcgcaatacgagcgcagaacttctttcggttatgggtctcaaagtcctttttggtggtgactaagatattggcggaaggatagagacgcagaaactccgacgcccactgctcggtcagatggtttggaaccacaaagagagatttctggcacagtcccaagcgtttggcttccatcgaagcagccaccatctcaaatgttttgcctgcgcccacttcgtgtgccagcagagtattaccgccatacagcacatgggcgatggcgcttttctggtgttcccgcagggtaatggccggattcatgccgccaaaagtgatatggctgccatcatactcacggggacgggtggagttcatttcttcgttgtactggcgcaccaaagtctggcggcgctccgggtctctccagatccagtccctaaagacttcccggatcgcctgctgtttttgggcagccagggtggtctccttggcgttcagcacgcggcgctcttttccgtctgcgtcctctatggtgtcatagatacggacatctcgcaggttcaggctgtcctccaaaatcttgtaggcattggcacggctggttccgtaggtggtgtaggctgccacatcgttgtaggatacggaagatttccccttgatctgccattcagcggtaaaggacgaatagttgacctcgatactgcgctggagataaaacggggtgttgaaagtctcatacataaactgctggatatattccttgtcaatccaggtagcgcccagacgcacctcgatctccgacgcatccaggtctttgggctgcgcggcagtaagagcttccacattgactgcataaacagggtcctgctgtgccgcccgctgcgcctgacgcagttttcggcgtacattgccggagaggtattcatcagcagtcacataatggggcgttccgtcctgctccaactgtcccggtacacggaagattacgccttgcagctctccgcccagttcttcttttgtttttccggtaagctggctcatatagtccatatccacgcaggctttttccgagatggacaccgccagtgcttcgcttgccgtatccaccacagccaccgcctgatggggcttgatggtccgcttggtgaacatatccgccttgcgctccagctttccgtcctcgtcgatgacttccagcgcacagagcaggtaataggaagaatcatctgcataggccagtcggtttgcacggtcattgataaggccatattttgcagaaaagctgtcatagaggctgttcagttccgcctgcttctgggtaatggtgctgtccggaaccgctgcatccatctgaaggtcgatcagttcctgcacacaatcgcgcagtcccacaagaccttttacgcgggcttctgctgtggtgttgaggtcagggcggaccatgcgactgttttcccggtagtacacctgcccgtctacaatggcataggaatagttcttcacattaggatcggcaggaatggaggtgtcaatggcttcgccttcgcccagctccggcagctctgcctcctgataagtcccatgaatgtacttcacagcatcatgcagctggtcggaaagcttcagttcctcgatggggttcacagtgtagtccataccatgagcagtgcttaccggctcctgtctgcccaacaccatttccgggtgctcaataaaataccggttgatggcaaatccgtcctccgtctgtccggtctgggtccattccggcacgatgtccagcgggcggtcccgcttttggaggaagatgatgtccgataccacctcggcaccggcattctttttgaacgcgtcattcggcagacggatagctcccagcagctcagcacgctgagcaagatagcggcacacggtggaatccttggcgtccatggtatagcgggaggtcacaaaagctaccacgccgccggggcgcacctggtcgagtgctttggcgaaaaagtagttatgaatactgaaattcagcttgttgtaggctttgtcgttgacctgatactggccgaaaggcacattgccgatggcaaggtcaaagaaatcacgcctgtctgtggtctcaaagccgcctactgtgatgtccgccttgggatagagctgctttgcgatgcgcccggaaacagggtccagctccacgccgtacaaatggctgtttcgcattttctccggcagcataccaaagaaattgcccacacccatagacggctccagaatatttccggtctcaaatcccatacgttccaccacttcatagatggcctgaatgaccgtagggctggtgtaatgggcgttgagtgtagagcttctggcggcggcatattcctccggggtcagcagttcttttagctgggcatactctaaagcccatgccggtttctccgggtcaaacgcatcagagagaccgccccagcccacatatcgagaaagaacctcctgctgttcggggcttgcctgctgtccggcagcttccagctctttcagcaaacgaatcgcattgacatttgcctggaacttggctttcggaccgccttcgcccaaatgctcatcggtaatgcggaagttttttgcattgcggcgcaggttagccttgtattcctcataggaggcttcttcggcagctttggcattggggaaggtctgccactggccattgacctgaatagaaaccgggtgttcatccagcacttcctcaaaggttttctccggctctgtcacaggggctggcagctccggctcctcgatatgcagtcgttccaccaccacatcataaggcagattgttcttatcgcccggatagacggccatggtctcggaatggaaggtcggggattcggtagccggttggggctgttcctgtccaaaaccgtcctgctgacgggcatacatcccgcgcagcaaaggcgcaacctcatcccagcggaaatacagcatagccagacgcttttcctctgcatccatgacttccagttctatgccctgtgccgtggtacggtaatcggcaatatcgccggtctccagatccagcgtctcgatctcacggggataggctctgctcagccagtaggcgatctcgctgttgctcctgccggattgcagcagcgtggaaatctgctttttatccgcctcatccatcagtccatgagccaatacatcccgcaagtcctgatctgccttgttcgggtcaatgggaagaaactcggtatagtaagcattgcggcggtctgcccgaagcagctgctcgaactgttctttacgctctgcccggtagatgggatataccatcccggtgggcagaagctgtacagtgtcctcccgcagctcggcgatctgataggcgtcatcctcgatatacacggtatcgcccacggcatagaccggggcggcagggtcataggaggttctttgcggaatagggctgcgaacggcgtcatattcctcatcggaaatggaaacttcggaagtctgctctgtctcggcagctgcaatctgctctgcatccgacattactcgctggataaacgagtcattgtccagtttttccgggtctgccacctgaccgttgacgatccctctttcctccagagcttcccggatggcgatagggtcgatgttgtcaaaacggtcctgttcttcttcggtatagaaccggtcctcctgaatgagctgggcaatccggcgctgtaccttgggccagggcagctgcatttcctctgggctgccggcacggacaacaaacaggctgttactgccgccgtattcctgagccagccatgcggcggtgtctttctcccttgcatggtccttcatatagcggacaacggcgtgtttactctcgatattgccgttccatgcacaaagggcagaatcaatatcttcctgagaaagagggcgcagaagctcatggagctttggataggtttcgtcgatcacttcccggtgcagtcgctggcggaactccggcacatccgaatagaggcggatcagctccatatccttagagccaaggaccgcacggcgcacagcggcattgccctcaatgacagcattctcatggtcagaatgaccgcaggcattgcggtatgcggtatcctcggaaatggcggcagttaccacgggcttgtactgctcaaactgctcccgaagggtaggctttggcgtttcttcctccacctccggctgctgggcttgaatggtatcttcctctgccagctctttttcagcctggatcttgtcatactgcgcctgttcctgttcggtaagatagcggcctttctggacaagagaggtaatgcgcttggcaaccttttcccagttcagatgaacatcagggcagtcctgctttttatagtgcagtcctttcccgtcgtgatcttcgccgctgtgtgttgcgccggacagggcatgagagcgaccaccaatgccatactcgtttttgaggaatctcactttctccttatccgtatggtttgccatgaagaacgcatagatacgaccttttcctccggcaaaactgctgccgctggtcatggcggcatcgatctcatcctcggtaatgaagtgctggacggttggcacttgggaaaggtcagaagtaaaagttctgtggggcaggtcaaggtctttcaggttctcccaaatttcccttggcctatgatagtgaaagcgcagcaggtcacggtcctgctgataagcggtccagaaggcggcgtattcttccttaagggtctggcggaaaaccgggtcactcagctgctccgtcaggcggcgggtctcctccgggaacccattgcctttgatctctgacaggcaggacaaatatccggcttctctggcttcctcactgaaatcgtgatataggttccagaactttgtggcaaggagggagcgttcatagcctgccgcttctgcaagctccgcattggaggcgaactggccgctttccaaaagctccccgatacgctctgcggcgctctcccaggaaatgacctgggcagacctgtcataacggacagacttcccatgagaaagatggataccatcctcggcataccatgcgctcacactgccaaggccattgccgccgtggtacagcgttttcagtatcttggcaatctcagcggtggttttctgcttttcaaaggctgcaaccacacgctctctctggcggtctgtattgccgcccaaacgcagcacatggtcaatatcattttgagcaaaagaaaaagcagaggatgtatgcgctacattctctgcttcatctatggattggatctgctccgcttcggagaggaacaggtttagggtcagctgttgataagctccgccatcaggatctcctctgcctgggctttgcaggtgttcatcagccctacccacttcatgggatcgctggctttcagttcctcggtggctcccgcttccttcgccagctggggtatcatctgctccagtctgttctgggcggtctcgtcgatctccagaaggtgcgggtacagcttctcgctcagcaacaggttgtagaggatgggacggtgttccttcagataggttttcctcatcctgccgtacttgcccaggggtttctccggctgctggctcagcttcaggtcgggaatcagatagtctccgttctggatgtaggtcatgggattgttcatcttgcttgctcctttcttggttggcttcgcgctctgcatttcggacggtaacgccgatctgccgcagcacctgctggttgatctggctgaccgctgttcccagcgccccgatggtggtcggggtattgaaatcaaagatcgccatgaaatcttcgtggtcgaaatagcgttccggctccagtccgcagcgggacatcaatgcgtaagtgatgctgacggtggcggctgccttgaactgcactccgatgttatactcatcatattcctccaaaaaggaaccgtcaacgatgtagaagaagtcctgctgatgctccgtccagtattcctcagccagtttcccggctacctcggtaagttgtccggcaaggtcatcgccggaaacatcataggtacgctccagcatggcctgcacggaatcaagatggcgctcctccagctgccacagccaaggggtacgggaatgttcacgggttccggtgtcggaaatatcgaacacatagcgcaggcggggtctgtccccggaatcatccaccagagcgatccccttggaaccgcgccttacatatcggcccatcttttcattccacaggtcgtactctgcacaggcggtagcgtccgggcgctgggcatagatcatcagctgctcatggaacggatacttgtaaaggcgggaagcagtggtgagaaaccctgcccattcctgccagctccccgtgagctgcgttgccaccttgtccgccatctgtgcatatcgttcagctttggttggcatggtgttctgtcctcctttcggtttttgggtaaaagaaaagcaggaaacctaaatgatttcctgctgggtgaaactgtgaatattatattttagttgtttaatatctctgcaatcgtgtttggtgcatattgattgagttcatgtcctgcatttggaacgatgtgcaaagtagcttggggtagcaattcttttagctttttagaagccttcagattggcagtatcctttttgccacacaaaattgttactggacaacgaataatgtttaattgcgaagtaaaatccaatgaccgcatagagtgagccaattttatggtgttgctttttgatagtcccataccttcaaaagccttgtttggcatacagcggaagataagattttgaaaatctatcagtaaactgggaactctatattgtgcgccaatcaaaaccagcgaagctactttttcttcatgccgaatagcaaaatcaatcgcaagaagcgcacctaacgaaagaccgcagatacgaagcggctcttttacttcagaataccgctgttctaaatcgcccaaaatcttcaaatatgatatttcatcttctgttgaagaaaaaagttctggacaatcgacatcggaaattgatagttgttggactacttctttccagtcctgtgcagtttgtcccaacccatgtaaaagaaccgttttcattcgacacctcctaagttcaagatatttatcaacgcacaaacaaactggaatctgtcgctttaatacccgtggtcaacatgttcccaattcccactgtcattcctaattagaatccatttccaatcatcatatgttgaatccggattaagcgaaccatccccacctgatgagtctacatcgaaagatgataatattacgattgcttcatccgcgtcatattgttcagcccattcataaaattcatcggcgtatgtatctccaggataggacagttttgtcagtgtgcagccgtcaaattcgttgccgaaatagtcttttactgtttggaaagccgcctcaatatcactgtctgaatatatttccgatggtttccaatcaggaatttgaacattgtcaatattcccaccactattctttccaccacagccggcaagaacaaaaatcattatcaaagctgtcagaaaacagaataaagttttcctattcatttttcgatacctcctacgaattccaatttgttgtttatgcttacattatagttcattcatccctccaagtatagtgggattttgtaaaggattgagagaaaccgtctttccatcgaacagtttctctcactatatcatcctgacacgatcaatttactggtcaaaatccggatacagctccagctgggcaaagtcctcatcggtcatcgcacagagccttgtaagggcgctgtcggtcagctccctcagttccgtttcctccgggaccagctcgccgcgcatctcacgcaggctgtcgatcagaccggtgcggctgccggtgttgtaaatgcacatcaggttcatttcctcaaaagtaaagtttcccatatcaaatctccctttccgcgctctttttaggcgctgtctttttgtgttccgtccggggctggcttttcagctgttccacgacagactttttcttttcccgttcctcccggtggacagcttccgctaaatccataagagaaataggctggccgctgcgggcctgctgttccagctgcgccacggtcggctcttttggtccgttgttgatgatgccgtcgatcatgccgtagtcatcctccagcatcatttccgcatttttcagcggattgtccggcaggaatccgggaatctcggtgaaaccaacgctgtcgcagtaatgacaggataccttaccgtcctgtttgatcgcaacgatgtcgctgacgctcatggagggactgtgaaagtccacgggtttttccatattgaattgctgatagagcttttccagctgctccggcacagtgccagactcactcagaggagctgtgtaaatgaggtcataattgcttcggtctatggaaatgtcatgggactttaaccagtccagattcataaagcgcacattctgcggatcgtcgcggctcacctgatagatagcaaagctgtctctgttctgggaaagaaatgcctgttctcgttcctgctgatgtgcctgacgctccatgactttttcatggaactgagggcttttctcccattcctcacgatccacaccgaaaagaccgccatgctccatgatctcctgcgggtcaaataccatgctctccgtattgtcctcatgcagcacatagacagtcaaaccggcggcatccagttccagtgcccgttctctggtaacagggagcattccatcataggagtagccgtattcctgcatatccggtgtagagacctgctcatccggtgttgggtattcatccaacgcctgctcctgtgcctccggaagctgggaagaagcaatcatctgactggcctctgcctgcatctgctggtaggctgcttcctgcaaggtctcaatcatggacaggggggcgtgtctgagcgaagtgctgtccagattgttgtcatcacaaatctggaaaactgcatttttgcgggaaagctccggcatattcagctgacctccatccagctctttcatggacgcagcatcgtatagggtgtagtcccagccgctgtcacagggctggatatgaagataggtggcatcgtcgatcagaaacaaagcctcctgctggttggcgtccgcccccagcacctccatttccggcatagcctcagccagatcctttaccgctttctgtaccagaggattatcacggtaatagtcgattgcctggatggtgtccaggtcaatggtctgcccggtcaaaatcgggaacggtccttcatagtcgctcccatctttcagctcaaagccaatgcccttgatcccgttcattcgctctgccggaatcttctgataaatgcggatcgcttcctccaaagacaggttatcgtggtattctccgaggtttggaaactccatacactctgctacatagtaggtcagagtatccttagcggcatctgctggctgctcgatcggggcggtttccggttctgcttttgcattggggtcaatcccacgctctttgcagatttccttatagtggcgctcaatgtcagagatcaaagtgccggaggtcttattgatggtctccaaactggctctcagttctttcagttccttgccctgactccagctggcaatatagccgaagctgttttctccggtctcaatcttaaaatatttgcagaccgcataggaaatgctttcagcctccacttcctccgtgtggcgatttttgattgcctgtttttctgcggttggatcttcctcaactgcaagacgccattcaaactggttttcgtccacatagcgccaatccatatcagaagcaaactgttcagcttctctttctgtggcaaaatccagcttgaaatcatgcttggttccgccttcactctccagcacaaccttccatgacggcagcatttcatgttttttagggtcatggagcttgctgtgggcaatctcgtggactgtggccgaaaccgtctgcacttcgctcatgccctgacggatggcgattttctgatgttcggcagaaaaatagccgtctgtatcggcggccattgcttcaaaagtgatcggcaccggcgcactgcggcgcagggcttccatgaatgcctcataattgggtacattaccggaaagggaggcggcaagctccggcaaaggtttcccgtcggtctggctcacatcaaaaaccttgaccgggcgaaacatggggatctcgatttctttttcctctgtaacgatctttccgtctttatccaaaatcggagccttggtatccgggtccagtttctgctcctcgattttcttcttgtacggtgtgggggcgatgatggtaatgccatgctcgcccttttttacatgacgctcaaactggtctttccacttattgtatccggctaccaatgtagcgtccggcttctgcatatagatgagcatggtgttgtttaccgaatagcggtgaaatcgggacatgacagacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttctgcaatccatgccttttgttcttcttcactttcataaagaaaaaggtccagcaggtattctacataggctttcttctggattgcttccacaaaacgggggtgcggttcttcctccagtgtcctgggagaacggtcggcttcccattttttcagcagatagtagtaatcggacagtacgcgataacagcgctgtcgatcctcccgaaacttctgtgcctcggttttttgccggacatatctcctgcggggcggggcctgactgtcatagatcaggccaaagtcctgtgccagtttctccgccgcttcttttggggagaggttaaagagctttgcggtaaagtcgatcacatccccatctgcaccgcaaccaaagcagtggaaccgctggtctaccttcatgctggggttcttatcatcgtgaaagggacagcaggccataccatttcgtttgacctcgatcccataaaacgctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctccctgactgatacacaccgcttggggacggtaaagttatgggcgtcctttcgggtgatctggtcggggtgcttttttgccagcagttccagtttctccatcaggcggggatcgtgggtgtagacctcagccattggttctgcctggttatagaggagaatggtttcccgttccactaaagagagcttcatcggctgcctcctttccgctggtcaaattccagcttgaaattggcatactttccatcgtcctccaaaaccacagtggcatcgtaggtcttgccggttttctccgaatatagccccgtcacacggacacagccatcgttcagcagcgtagacaccacagccttggtcggctgttttttcttggcagcccaccatttgttgtttttccagattgcaaatttacaagaatcattctgacagaagaagcctttttgcagttctgccacttcaccgccgcagcgagggcatttgcccaccacctcacggggcggagtgaacaggtactcagttcccttgatgacctgataagtccccaccagatctttcagcatggtgctgatcccgtccaaaaactcctccggggcaagctgcccgcgctcgatctcgcccaggcgatactcccactcggcagtcagaagcggcgattgcagttgttccggcagcaccgtgataagggatactgcatcgtgggaaggaagaagctgcaccgtttttctgttcttttttcgctccagaaaaccggcagataccagcttttccaaaataccggcacgggtggccggtgtccccagaccttttcgctcggcatcctccggcatatcctcttttccggtagtctccatcgcggacaatagggtgtcctccgtaaagtgctgaggcggactgcttttgccttctttgacgattgccgcagaaatcgaaagggtctgtccttcggtcagctccggcagggctttctctacgccctcttttttcggctctgtatccttcattttggcacgataagcgtcctccagtgctttccatccggggtgcttcaccgtttttccttttgtggtaaactccccaccggcacacgctgcaattacaacggtttccgaatagatatggggctgggctacggcgcacatcagacgcagggccaccagctccagcaccgctttttctcccgcaggaagggcagaaaggtctgcatccttgagatttctggtagggattactgcgtggtggtcggttactttcttatcgttgattaccgtctgcggatcacaggtaatagcgattcctttgcgaaacggcatagcattggcaaccagattcaccaacaccggcaggctgtctgccatatcgccagtcagatagcggctgtcagtacggggataggtgcatagcttcttttcatacaggctttgcagatagtccagggtctgctgggctgtaaatccaagcaggcggttggcatctctttgcagagtagtcaggtcatagagggcaggcggcttttcggacttttccttgcactccatctttttgattgtgacatttgcaccctgacaggcttctttcagctgctcagcagcaaccttatccgccatgcgctccccggatacggtaagaccgggcagctccagcgccacggtataaaagggaatcgactgaaaggtgtcgatctcagcttctcgctgaacaataagcgccagcgtcggggacatcacgcgcccgatgttgagggttcggtgatacagcacggaaaaaagccttgtcgcattgatccccaccagccagtcggccttggcacggcagagggcagcatcccgaagtccgtcatagtccgcactggggcgcaggtttgcaaagccttcccttatggcggagtcctccatcgaagaaatccagagccttttcatcggcttcttgcaacctgccagctcatagacgctacggaagatcatctcgccctcgcgtccggcatcacaggcatttaccacctccgtcacatccggggcgttcatcagctttttcagaatatcaaactgctttttcttatcctttcccactaccatctgccaatgttccggcaggataggcaggtcatcatatcgccacttggcatacttggggtcatagctgtctgcatctgcaagaccggccagatgacccacgcaccagctgacacgccagccgttaccctccagatacccgtccttacggacggttgcgccgatcaccgccgccaaactctgggcaactgatggtttttcggcaattaccaatttatgttgagccatgatggttcctcctctctttgagccatcgggacatttcccggtgacagatacctacgcagggtcttccataattcccgcaaccatagcaggggtggctgtggggtaaagaaggaggacgggaagtttccttcccgccctccggcctgcgtgtcatcatgcgttcatagggactgtctgtgaaacgggtcatttcacactgtcctcatcatcttcttctgtgctgcccccgtcagcgtccggctcgtccgactcctcatcctcggtttcccattcctcggaatcctcctcgccataatcataatcgtccagactgtcattgcccttggtcttaggcttgttcttaacgagcttcaagtaggcaaatacgccaccgcctcccagcagagccagcaaaaggactatcgcagccgggttcaatccggcaggcttctctttttccggctccgatgtttctgccggaggttccggtgctttgcccgtacatttactcttatcagttgcgcagaccgggcaggccgtattgactgcccctgcttcacattttgtcgtgcagctacacacagcagccggctcctctttgacattttcatcttccatcaatgccatcaaatctgcttcatccacctggttcagaaagtgaacagcagtctttttatcctcattagccctgtcgatcaaaatgtaaaaatagttgcccgccttggtggtaatggtaatgagctgcttattgccaccaaaatcatccaccagagcggcattgccatctggtgtaagtgccggtgccggttctgcttcttccacaatcacattgctgtcattggtagaatcctctgccggtgccgccggagcctgttctgacccctgtgcgaaagcagggatcgtaaagccaaatgccacaaccattgtcaggcaaagggcggaaagtgttttgcaaattcttttattcttcataagcggtaacctcctgattatttgattccgacagtgctgtatctctaccgtggttcattccaccggaaagcatagcgttcagctgtgctggcgtcatgcgtaacgcacgaaccatctgaacgatttccagattctctgcctccgttttctgtgcttccaggatcttgagcttttcctgatattccgcaatcttctcacgggttttctcaatttcctggtcgatacgttcaattttgttttttgccataaccgttcactcctttccacaaagtctgttaccagttcatcaggccgtagcccttaatactttgataattcaggtcataacttttgatcttgcaggcatcgccggaatttccctccaccgtataaacacggctgccatccgtaccgatcacgatacccacatggtctgctgtcccatctaaatcccaatcaaagaaaattgcatctccgggagccagattgttatagcctcttgcaccccattgtccatgagactggaaccacggaacgccctgccactcacagcctgcaaagcgcggctcactttttccagcctggttataacaccaggatacaaagcaggcgcaccactccacgcggctgtcaaagccataccagctccaataaggatagccgcccacattgccgacctgacgcttggccagctccaccaactgcggatttccgggacgggttccatttacgaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggcttgctggtgagtttcacattcaaaatgtaatactcataggggacttcttctgaggtggtctctccggtctccgggtcggtggaggtctccgtgcggtagcgaatctccacttcctcagtaagcgtcagctgatactgtgctgcaaacacacgcgccagctctgcctgagcgctctgctgggtgtaaccttgcaagacggcagacagaaatgctgccagctcatgagggtcatgaccgatcataccaaggtcatagcgatactcgtcataccctgggtggctgctttcaatgttgtcgatttcctcctgcaactggacttctctggctgcataatctgcttccactgccagcatttccgggtcatccgacggataagtggtgccggagagaacggaaccgatgctctgcgccatcatggagcaggaggacatggtattcatcagcatacaggtaatgaggaacaaaacccctgccatcaggaaacccttcttgtggcgcacgacgaacgcccctgcctgctgtgccttttctttcaccgtccttgcggcttttccggttttggacgcagcctgggcggtatttccagcagtctgaccggcgtgtttggcggcggcatactgccttttgatggcctgcttttgctgccagcgggaaagcggattgctggcaaactggggattttcctgcaaagatttctggtacagaacatttacatttgccttttccagttgacgctctgcctgggctgctttgcggtacggcttcagcttgtggctgcgatagccctcccgcaccagataagcgccggtctccaccgcttcctcggacttgtgggcgctttccacgcccacattgtcctgctctgtttcccggatctctttgtggagcttgcctgcgaccagatggacgggagcttccctgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggatcggcttttccagtgcaggatcagactgttcctcatcagtaaagcgcaggcgcggctctttattcaaaccattctcccagcatgagggaggacatcatgtagtgcagctctgcataaatggccattcccacaggatcgttgaacatacagccggacaggtaggcataaaactgtgccaccacatcggacaggatcttcgcctctgttccttccagaatcaggccgcccataccttctttagcacgaatggcgctccagacctctgccagacggagaagccccacctgaccggtctcattcagttcggctgcctgatctgccgccgtgcggcactcacttaccgcatcggccatgaccgtaagcagctggctgcgctgggcatttaccgccctgtcaaaaaacatcagcgggtttttattcaaaatgttggggttcataatcattcatcctcctttttcaattcttgaggtttggtggtcataatgcggtaaagttcggtgttcttcgggaagtggtctacaaacggcaggatcgtggagccatagaacaacaggccctcgccctcaccggagtgggtcacatagctaagctggtgcgtggaaatccccagttgcttcgccaaaatctgacggtctccgcctgcctggttaagcatatacacgaagtcggaattttcaaagatattttccacctcgcggctgctcaaaaggtctttgacattctgggtgatacctgtcggaataccgccccattttctgaatcgcttccagatttccaccgtataggcggcggtctgctcctccttcaaaagcaggtgcatctcgtcgatgtagtagcgggtagacttgtgagcggcacggttgatggtaacgcggttccagacctgatcctgtaccaccagcataccgattttcttaagctgcttgcccagttccttgatgtcgtagcagacaatccggttatcaatgtccacattgctctgatgattgaacacattcaaagaacccgttacatagatttccaatgccgttgcaatgtactgagcttctttttcttcctgctcccgcaacaggttataaaggtcctccaaaatcggcatattctccggctttgggtcattgagatattcgttgtaaaccagccgtacacaacggtcaataatggttttctgcaccggctgcaagccctccttaccgcccacgatcagctcacacaagctgaggataaagtcagacttgagtgacagcgggctttcatcatccgaatagtccagattcagatccatcggattgatatagttggttgaagtaggtgagatcttgatgacctgcccatgcagacgctcaacaagaggtgcgtactccgcttccgggtcacagataatgacatcatcactggtaagcaaaaagcagttggcaatttctcgttttgcgctgaaggacttaccggaacccggcgtacccagaatcaggccgttggggtttttcagcagctttctgtccaccatgatgaggttgttggacagagcattgatgccgtagtacagagcttctttcccgttctggaacagttcctgcgtagtaaagggcacaaagatagctgtggaactggtggtcagtcctcgctgaatctcaatctgattgagacccagaggcagacagctcatcagcccttcttcctgctggaagtccagcctggtcagctgacagttatacttctgggcaatagagcctgcctgaaagatgttgttgccaagctgacggggattgtccgctgtgttcagcaccagaaaggtcaaaaggaacattctctcgttgcggctctgcaaatcctgcaagagttttttcgcttcactgccgtaggtagcaaggtcagatggaatgatgtccatgtcgtatccggcacggactgcttttttctgttcctcgatcttgctgcggtccaggtcggtaatcttccgctttaccgttttgatggctttcacctgatccaccgactgaatgtgcatactcacaatgagcgagctttccatatccaggaaatcagccagcagacggtcattcagctccggtgcgaggatctgcaaaaaagaaacagctccgtatttcttacccatacggaactgcttgccggtgcggaactcaaaggagcttggtgcaataaaatcctttgtggacagaccggaaggagccagccagtcccattcaaactgaaacgggagttgttcatccatgtggaataccgcatgaagctgaaaaagcctttctttaccgtccagcgttctggcagctacaccaagacgcttgaagttattaagtatatcggtctcaatacgctccagacggggcttggcggctttgatgctgtccgcgtcgataccaaaggtcaggtatttggtcttgatgagaccgttgttacctctggccagctgattttgcagcattgtggtgtattcctcgcggatactgtcaaaggcgtccctctggggcgggatggaaatggagttagcaaaggtctcctccgatgccgcaagattcaaaaaagacagctggaaatgaatcgagctgtcaaaataattgaggaaatcacaccacccctcaaagattgccgtcttatcttcgttttgggagagctgatagttgatgtcctgaaactggatggtctttgtgtagtggctgtccgatatgcggcagattccgtccggccacatccgttcataagggatactgtcctgcgcagattttccttttttgtccgtgcggttagcgcgggcaatggccgcttcgatctgcttcttatcggcgcgggacagttttttctttgtctttaccggctgcacagttttttcctcggtttttccgaacatccgatgcagccatttttttattgcggtgaacaatgtcatacacctccttatcgagcatttcctgccgctttaatacggcataaaagttgttggtctggtaaggtcgctgctttggacggattacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtgaagcagataagctgccgcttggtcagattgaacatgacctttgttttgacttttgttaagtccttgggtacgggtacataagccaatgtggaaacctccttccgttttagtgcgcctgaaagactgatttggcgagactgcctgttttgaacagcgtaaaacatagcagtacggtgtagcccacgcagctccagattgccatgatgatgtcatcttccagagcgatgttctgcaccagcacagcataaattgccacgcagacgataatgagaaacgcctgaaagcccagtgccagcagggatcggaggtaattctgtcccataccgccccattctttgcccatcattgcagccattggaacgggagccaccgaagttacaaggtagatctcgatcatacggccataaataacgataaagatacagatatacaacgcccacatggtaatgccaataaagagggattggaaccacagtccgaacagcggtcccaaatccatttccatcaacctcggttccagatcggtcataactgaggaaatgtcaatggacgcatccgaattgataatccctgccgcctgcgccaccacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcatcacgatagccaggatcacacctgcaatcggcaccatgatggagtttgacagattctcaatcatattgaaaatactgccattccatccctgtggggtctgtcctacctgtacggatatatccgcgacctgttggtttacactgtcaaacatccccgaaaggttgctcataataccgcccaccagcatttctttcagccaattcgtcagggcttcaagtaagaaatccatacggtgtcaacctcctttccgccgcccccgcagagctgcgggagcggcaaggatttcatgcagaaacgcttagacagagaacagcccggagagcagaggtacaagaaccatgccaacaacggctacaccagcaccggccatgagctgcttcattccctgtgattttgcgccagggttgtcgttgccgtaaccttccaacaggttgatgacaccccagataccaagaccagcgcccagagcgataacgagagtctgaagaacggtaattgcctgttcaaaaaatgccataaataatattagccggaatcatttgaatgattagttaggtttgtttcataagcgcacaaaagccggaacaatctgccctcaatctatgagagcctgattccggctgtcctcctttttcattattttgttgatgattgcccgctttgtacgccaatggcctcaacagaggcagttgcggcaaatagatacgatcactcctttctcagcggaaccgtattacacgccctccgtgtctacttcatatacatcgcagacctcatcaggcttgagttttagtctggcagacaaaaatgcttcaatatcaaaggtatttcgcttgtctgcatcagctgtgtatttgaaattagggtgtctggtaatgtcatacttgtctgaaagaaacggacgcacaccgcgcaactgcaagatgcacttgccgccatccataactgccagctcgtcctggctcatcagctcttttcccaatttctgatagttgagcgagtgggaggtctcccgtccccggctctctccggtgttgtaagtgtctatggtctcctttcccagaacagccgccagctctttcagcgttgttggctctttgccacccaggaagatagaagtatccatattgccgatgatggtatcggcattatctttgtaaattgccttgagctggctctgtgcctgcaacaccagacaggcagagatttcacggcttcggatggtagcaaccagcttttccagcttcggaatctgcccgatgttggcacactcatcaatcagacagcgcacatgaaccggaagcctgccgccatacacatcgtcggccttttcacaaagcaggttgaataactgggtgtagcacatggaaatgagaaagttaaaactgtcatccgtatcactcataatgaggaacagagccgtttttctgtctcccagcgtatccagttccaactcatcgtaggatgtaacctcgcgcagctccgcaatatcaaatacggccagacgcgcaccgcaggaaatcaaaatcgacttagcggttttgccggctgccagcttatatttcttatactgccgcactgcgaagtggtttggcttttccgattccagtgcatcaaacatcaggtctacgggatttttaaactcctcgtcatcctcccggacttccatggcgttgatgaactcgatgagggtggagaagttttgctcctccaccggagcttcatagtggatatatccgatcaatgcgcaatacagcaatgtttccgccttgacccagaaatcgtctccggccttgccctcgcctttggtattagcgattagcgttgtcaccagcttcaaaatatccttttccgagtggatatatgcaaaggggttatagtgcatggacttcttgaagttgatggtatttagaaccttgatgcggtaaggctcataaatgaccttgccatgcttatccttcatgggctttccgtccttccccagcttgggcgcacccctttggagcatttttccgcactccaccaaaatggttcccttcgggtcagtcacgacgtagctgctgtgcatctgcatcagattcggtttgagccagaagcgggtcttaccggaaccggagccgccaatcaccagtacatttttgtttctggcagtcttggggtccttggggcggctgttcatggtcaggctctccgttttcgtcagaatcacattgttctgaaatacaggatcaacgtaaggtgcaatatcctcacgggttccccatcgggccgaaccatattccaaaccatgtcgatatttcttggcattcttgcttttaagatacaccgccagcctcagaccaacaccgcaacacagccctaccaacaagtccaatggatgcaggcttggccagaaactttgcaacgccccaggcagaaccgcaaccagcgaaagaaacttttctgaagtatctgccccttgtgccattcgccatgcctctccaaaattggtagcaaacagccccagcaggatatacggcatattcagcaaaatgagctttttgatgtccaatgtctttttcatcgttccagctcctttcgcttggtgcgatccaccacagcatttttaaccatctctttgaactggttaagttttgccagtacggacgggcgctctgttttcgttgcctttttgacctttttgttggtgtactctgtaaaagctgctgtcagagcatctgcatcacggcctttgaaaaaaattaggtactttggcggagaactgctgcggtcctttttcaccgcataatccacaccatatttccgggcgattttctcaaactccttgatagaggggtctgtaatctcaatgttggatattccctgattctgcccgacaagctgcttcacagtctgttttccatgcggaacaaccggcgcatcacggcttctctgtttttccagcttcttttcctttcgatgtgccatgtacttgcttatggcagccttaaacattctgccggtaaattttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaacggtcatagtgcagattgccctgacgtacatttgcgtggctcaaaatcttaatctgccccttttcctgactatccagtgctttttcataaccggtatccgacaggaacaggcgggttcgttcgcctttccagccaacaggggaatcgttcgtcagcacatcaaaaataatcatgtgccgggtgtcctccgcaaaacgctggaggtccatatatccatgaccgtgataattctgcgctcctgcctttgcccgcatttcttccatcagctgccctatggtctttccatcagacatcatgcttgctcctttctcccggcagttccgggcaataaaaaagcgaccatttaccagccgccatacagatcgtgatttacttgtgaggtgtaatgattgcttatcgtggtcggtgcattgaacagaacggtcagaagatactgcttcatgttacgaatttccgtggtgttcttctgtaaacagtccatgacaaactcaatgtgcgagttatccagcttcaagaacctggaacgaacgatttcatgcggaaaatcacttcctgcaatacgggtggtctttcgctttgcacagaccgtttccacgatcagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcacaatcccggaagggaatggaatcggtacttgatccataaatattttgtttttgagtatttgatttctctatatttaattctgcgggcttttccgtatccggtttatccatatacggattttccgtatctggtgaatccgtatccggttttctaagctgtggctgctcgtatatgacatactctgtatcgctgatgcgtccctgccgatcacgcagcttgtaccgtacaatgtaaccggcagcctccaattcccgcagcgcaccaccgatggcatccacaccctctttacagattttcgcaagtccgcgggttgtatagttccagtcctccggtaaagacagcatcatggaaagcagccccttggcttttaacgacaggtttgcatttcgtaaatgatgattgctcatcacggtataatcacgggtccgttcaatgcgaaaaacggccatcgacctcactccttccgaatttttggtacaaaaaaaccgcaatcctcattccaaagaattgcggtgttcaacacttttcaaattttcttgcatagaaccaaaacagcggctttcgaggacgcgcctctgtaaatggcttctcctgggcgaaaggaagtgtttgcatcactcgatcaatatccgttgaatccatgtcatgctgagatttgcaatcttcccggattgcttcttgaatttcctttaccgtacacatagtcattcctttcctttcgttgtatgagtttatgaacggcgacgttttcccggtttgaaatcgaggatgtgtccctcaatcacacgagcgtaacgcttgatcttgatctcccggcactgctggctttgcagggcagcctgatacccgtcctcagtcaaaaacagccgcatttcctctccaggacttccgtaagctgtgctgggacgcaggacggaaaactcaatcatccagcgggtgttatcccaaaacctctctacggcgagaattttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtgtcagaggtaaatgtcactcggtccagatcgcttttcttttcctcacccatgatgacacgcatcatatcgagggtcagatgcccctcctgactgtattttttgagccgctgggcttgagaaagagaaggggtagcctgttcgctgtccatcgcgtccaacaggtctacctgttcctcctttttgagaaaggacagctcataggcgggatttaaggcaattttcttttcatccaccatgtccagcagttcgggaatcagctcagtcaagcgaataaatctctgaacctgcctttgactttctcctgcttgatttgcaaccagctgaattgatgtctgcgacttctcgccaacttggcgagaagttaaatctgagcgttctccctgatgttttatagcctccaacttcattttataggcaaaggccctctcacttggaagcaggctttctcgttgcaggttgctgtcaaccataataattgtggcagcgtcatcgtccagatcacggacaattaccggcatggtatctttttctgccagttcacttgctctgtgccgtctgtgtccggccaccagttcataaccaccctccgggtcagggcgggcaatcgcaggaaccagcacaccatactgcttgatactgtctgctgtttccatcattgcttcgtcatccttgactttgaatggatgccctttgaacgggtgcagttccgacagcggaatttctactactttttctctctgagcatcggcacggctctcctccgtagaaaacagatcatctaccgatgccagctctacttttttcgcgctgcttttcaagtttcaacacctccttcgtcagatttcgatacccctctgccaccttgccgccaggatcatgggcgaaaatgctttttccctctgcgctgatttcctttgcgcggacagaatgagggatttccgttccaaagactttgattttacttccataggtatcccgcagcaaagcggcaatctctttagcaaagttggtgcggttatccaccatcgtcagcaggataccgtcaatctgtagctttggattgatctgccgtttcaccttactgaccgtagatagaagctgttccagccctttggcgggcagatactctgcctgaacgggaattatgatcctgttcgcagctgccagagcattgactgtgagcatccccagtgagggctgacagtcaatcaggatatgggaatattgtcccttcagcgtgtccagatattgccgcaagatagtctcacggctcatggcgtttaccagagaaacctccataccggaaagctgaatatccgcaggcatcaggtcaacgccttctgcatgatgcagaataccttctccggggcgtataggatgatccatcaaaattttgcccattgcatccgacagtgtaaatggcagcttgtccggttgcggatttcccaagctgattgtcaggcttccttgtgggtccccgtctatcagaagcactttctttccggcctgtgccagacctattcccaagtttgcacaggttgttgttttgccaacgccgcctttctggttggcgatggcgatgatttgtgtgttcatgacttcacctcatttctgattgttgctgttgtttctggaaatagaaaaagccgccacttcaaaatcgtaaagtgacggccctttctaatgccggaatctctgaaataaaaaaagcacccagttatttgttactgagtgcctgcattagaatcatatttaattgttcagatttggtcaaattatgccaaaccctccagcgaaaaatccgggatctgagagtgccaaaatcaccctcaaaaatacccccgaaattgctctctggttgtcctattttttaaccactaaggccgttttttgaccccatttttgccggttgtcctatatttaaccactaaaaattgggtgaaaacggctctcgttaggtcaaatcaagtcaaactatatcagcccgtttaggtataagaaaaccccggaaaaccttgattttccggggtttttgaaccattttgatatagtctgagcagtcgattatcgcttgctgaactgcggagcgcgacgagctgctttgagaccgtatttcttacgttccttcatacgcggatcgcgggtcaggaagcctgcagccttcagagctgcgcggtactggtcggaatcagcctgcagcagagcacgagcgatgccgtgacggattgcgccagcctggccggtgaagccgccgccggttacggtgcactctacgtcgaacttgccctcggtgccggttacttcgaacggctgacggcaaaccatcttcagggtctcgagaccgaagtagttatcgatggtgcggttgttgatcttgatctcaccggtgccgcccgggaaaagacgaacgcgggcaacagaggactttcttctgccggtgccatagaaatatgccttcttaggtgtatacatcagttaatcctcccttacttttcccaggtctcgggcttctgagcctgatgattgtggttctcgccagcaaataccttcagacgggtagcggactgacggccgatggaattcttcggcagcatgcccttaactgcgagctgcatagcgaactccggcttctcagccatcagggtcttgtactgaacttccttcagaccgccgacccagccggtgtgatgacgatagtacttctgggtaagcttcttaccggtcagaaccgccttgtcagcgttgacgatgattacgaaatcgccgcagtcaacatggggagtgaacgtggtcttgtgcttgccgcgaagcagcattgcagcggttgcagcagtacgacccagcggcttgccagctgcgtccagtacataccacttacgctcgacattttctgccttagccataaaagtagacatggttttttcctccgtttatatatatcaaaaatactttgacaactgattgatcgctcgaaacgatcatatttattaaaacacatcattttgcgcaagtcaagcgaaattttgaaaaaatatcttcaatccaatacattctctttttttctcttttaatctctctcatactcacgaatactcactttgcatttcattttttgcatttgcgatttttgacgttttctgataaattttaatatgtacgatcaaaaaggagactgttatgcagaaaatgctttcctatgtccgccgtgcggtggaccattaccatatgatagatgagggcgacaggattgcggtcggtgtttccggcggcaaggactcgctcgcgctgctcgtggcactcagtcagctgagccgcttttatccgcaccattttacagtcgtggctattacattggagatgggctatgatgagatggacttctcccctgtacagacgctgtgcgacaagctgggcgtcgagtacatccgcgtccccacccagatcggccctatcgtgtttgatatccgccacgaggaaaacccctgctcgctctgtgccaagctgcgccgcggcgctctgcacgatgccgcccgcaaggcaggctgcagcaaggttgcgctcggccatcactttgacgatgtagtcgagacctacatgctttccttattttatgaaggccgcatttcgtgcttttcgccggtaacctacctcgaccgcgccgacatcacgctcattcgtccgctgctgtatgtgccggagcattatgtgcgctcgttcgccaaacggcatgagctgcctatcgtgcacaatccgtgtccggcggacggcaacaccaagcgacaggagatcaaggatttgctgaaaagtctcgaaaagaccatgcccggtgtgcgcgagcgcattttcggcgccatgcagcgctacccgctcgagggctgggaacccgacaagacccgccgcgattacaaatgatctgttccctttataaaaagaaaggagacgagaaccatgatccagattggcttttgcgacgatgatcccagcgtgctcgatgaactgcacgagctgctcggcagctaccgtacggaacacaacgccgatattgccccgacagccttccaaagcccgttcgagctgctggcgtccatcgaaaagggcgcacgctttgatattctgctgctcgatgtactcatgcccggcgaaaacggcatcgaagccgcccgtgagatccgtcagtacgactccaacgtgaagatcatctttctcacctcatccgcagagtttgccgtgcagtcgtatacggtgggcgcgtatttctatcagctcaagccgatctggccggagagcttcttccggctgatggattcggtcattgccgcctgctcgcgcgagagcagcgtcagcctgatcctgcgctgcaaaaccggcatcacacgcgttgaactggacaagctggaatactgcgaggtcatccgccgttccctgctgctgcacaagactgacggcaccgtgctcgaagccgccggcagcatggacagcctgtgcgaaagccttgccgaacacaggaattttctgcgcattcaccgctcctaccttgtaaatttagagcatatccagacgatcacgccgaaaacgctcgtcatgtccagccgcgccgagctgcccattccgcgcggacgctacaacgacatcaaggacgcgtaccttgagcacgccttccagaaagaacaggtgttcctgacatgatcgcactcgccgttgacctttgcaactccgttgccgttacgctgttcggcatcgcgctctctgcggcattctgcaatatccactggacgcccaaggcgaaaaagcgcatgctgctgtacacgctgatgatcttctgcctgtccggcatcgcctacctcggtgtggacccgggcttcggacgctatctgtatccgctgcacacccacctgccgcttgtgctcgcgctgtgctcgctcagtcacgaacgcctgtggccggtgatttccgtgctgacggcgtacctgtgctgtcagctgcggcgctggctggcgctgatcgcggtcgctatcttctccggcggagacaccatgcagtacgctgtggaaataatcgtcaccgtgccgctgctcattctgctgctcaaggccgcacctgccatccggtcggtgtcgcagtattcgcgagcggtgcagtgtcagttcggcattgtgcccgcggtgtactatgcgtttgactatgccacccgcgtttataccgacctgctgttctccggttcggctgtagtcgtggagttcatgccgttcgtgtgcagtgcggcgtacctgctgttcctgattcacatttccaaagagcagcacgcacggctgcgtttggaggagctgaaaagcaatcttgacctgcaggtgcatcaggccgtccgtgagattgaagcactgcgcatctctcagcagaaaacccgcgcctaccggcatgatctgcggcatcatctgcagtacatcaccgcctgcatcgagaatgagcagtatgagcaggcactgcagtacattcactctatcagcgaggaaatcgaagccagccgcgtgactgtttactgcgaaaacgaggccgcaaacctgattctctcatcgtttgccgaccgcgccaaggcgcagggcatcccgcttgcggtgcatgccgtgctgcccaatcagctgccgcttgccgagagcgacctgtgcgtgctgctctccaacgcgcttgagaatgcgattcacgcatgcagcgagcatgcggacggcattcccggacacatcgaggtgcagacatacgaaaaagccggaaagttcttcctgcaggttgtcaacgactgcacgcagccggtgcagttcagccacggcgtgccggtctccgaccgcgccggacacggcatcggcgtgcacagcatttgcagcatcgtcgagcgatacggcggtgtatacagcttttcggtcaggaatcagcagtttatcctgcgaatttcactttaataattgcataagaaaaaacgctctgttttcacagagcgttttcttataaacagtagcaaacaccgtgcggaactgtagttccgccgacagcattttagcgtttattggagcgcttccagatacgcatcttctccgcttcctgaatcagctgctcacggaaatccggatgtgcaaccgagatcagagcctctgcgcgctgccatgcagtcagacccttgaggtttaccttgccgtactcggtgacaaaccagtgcgcgcacggacgggcatcggtaacgaccgagccgttctcgagcgtcggacgaatacggctctcgagcgtgccgtccttcttcttaaaggtggacgagcagcagatgaagctcttgccgcccttggacagatacgcgcccagaacgaagtccagctggccgcctgcaccggaaatctgcttgatgccggcactttctgcgttcatctggccgaacagatccacatccacaatattgttgatggaaatgaagttgtcgatctgtgcgatggtgcgcgcatcgttagtataggataccggtgcagacatgcactccggattatcatttacaaaatcgtacagcttctgggtgcctgcgccgaacgcgaacacctgacggccgcggtcgatggccttcttcgagccgttgatcttgcctgcacgggagatgtcaacgaatgcgtcaacgtacatttcagtatgaacgccgaggtccttcagatcagactccgcgatcatcgaacctacggtattcggcatgccgccgatgcccagctgcaggcacgcaccgttcgggatttcctccacgatcagctttgcaaccgccttatcaacctcggtcggctcgccgcctgcgcccatctgcggcatttcggtgtcgctctcaacgatcatatccacctgcgaaatgtgaatgccgtcctcaaagccgccaaggcagcgcggcatatacttgttgacctcaacgatgataacatcggatacatcgcagacggctttcaggtgcgaagcctgcggaccgaagctgaaccagccatgtgcgtccatcggcgccacctgaatcatggctacattgacatgacggacgttctcgcggtaccagcgcggcatctcggagtagcgcagtgcgctgtaaaagccgaagccctccatgcatgccttgcgctcaatgccggacatgtgccacgagttccaggtgatcttgtcggctgcattcggaatatcgaataccgccggtcggcgcatgagtacgccgccgcggaagtttacatcctccagctcgcccatgcgggcagcaagtgccttgtccagtgcaacaggcgtacccgtacaccagccgtagtctacccagtcacccgatttaacaaccttaacggcttcatccgccgttgtcagcttctgctgatacagtgcagtataatccacgctgattccctccgtcttacttgttcttcattgtttattctttaacaatcatgcttacttatgattataatctcttttttggtacaggtcaacacaggttcgcaaaaaagagtgagaatccgtcccaaccgctccccgccctcttttccatatatttcaccctgttattttagattttgcacaaaataccgcccgattatccttcaaaaatgctgaaaatctgcatgaaaatcaggggttgattttctgcgctaaagtgttataatagtaaacaagatatgaaccgaattacaggaggttttctaaaaatgaagacgaagaaacttctcgcactgctgatggcaggcgcaatgagtgtatccgtgctgtccggctgcggcggctctgctgccaagaccgacgactcgagtgccgatgcggctgacacctcggcttccgctgagagcgatgtggattatgtaaagagcaacggcaagctggttatcggcatcacggatttcgcgccgatggattataaggaagacggctcggacgagtgggtcggctttgacgcggacatggcaaaggcttttgctgagagcctgggcgtaaaagctgagttcatcgagatcaactgggccaacaagatcatggagctggattccaagggcgttgacgctgtttggaacggcatgaccctgaccgatgaggtcaagacccccatgaactgctccgacccgtatgcaaccaacgcacaggttgttgttgttccgtccgacaaggctgacgctgccaaggacatcgagtccatcaaggatatgaccttcgctgttgagtccggttccgccggtgaggctgctgcacaggctgccggtctgaatgcaaccgcagttcagtctcaggctgacgcactgatggaagttgccgcaggtacctctgatgcctgcgtgatcgacctgctgatggcaggcgctatgatcggcgagggcaccagctacccgaacctgacctacaccgtaaacctcaacgaggccaacggcgaggaggacgagaactacgttgtaggcttccgcaagggctctgacctgaccgaagcattcaacgatttctacaaggctgcttacaaggacggcgttgttctttccttcgctcagaagtacggcgtacaggaagcaatcgtagatccggaggcttagtctcccatcccccagttcaatataaggcagaaggcggactaccgtcttctgccttatgtgtcaaaggaaataaagtaaaaaagaggtaaagaggaaacgacatgtttgccaatgtaacactcagcctgatgggcggctttgttaccaccgtacagcttttctgcctgacgctggtattcgctctgccgctcggcctgcttatcagcttcggctcgatgagccgcattacaccgctgcgcgcactcatcaaaatcatcgtctggatcgtccgcggcacgccgcttatgcttcagatcatcatcattttctacggccctgccctgctgtgggatatttccctgccgcgcttcaccgctgcgctggtagcgttcgtcatcaactacgcctgctatttctcggaaatcttccgcggcggcattcagggtatcccgagcggtcagtatgaggccggtcaggtgctcggcatgaccaagagccagatttttttcaaggtaacgctgctgcaggtcatcaagcgcgttatcccgccgatgggcaatgagtttatcaaccttgttaaagataccgcactggcgcgcaccatcgcggtatacgaggtgctgtggatgggcgaaaagttcatcaagagcgccggtatcatctggccgctgttctacaccgccgtattctacctgctgttcaacggtattctgaccctgctgttcggctggatcgaaaagaaaatggattactttaaataaggaggagccgttatgcctattctggaggtacagcacctttataagaactttggctctaccaaggtgctcaaagacatcagttttacattggagcgcggcaaggcgcttgccatcatcggctcgtccggctcgggcaagaccacgctgctgcgctgcctgaattttctcgaaaccccgaatgagggtaagatcatcgtaaacggcgagacactgctcgacgctgccgaccatgccgccaagagcgatgcgcagattcgcaagaaccgtctgcacttcggcatggtgttccagtcgttcaatctgttcccgcagtacaccgcactcgagaacgtcatgctcgctcccctgctgcaggccaaggaacgcccggactacaagcagaaaaaacacgagattcacgagcagatcgagcaccacgccatcgagctgctcgagatgatgagcctcgagggccgcatgagccactatccgcaccagctgtccggcggtcagcagcagcgcgttgccattgcgcgtgcgctcgcgctcaagccggatatcctgtgcttcgacgagccgacctcggcgctcgaccccgagctgaccggcgaggtgctgcgcgttatccgctcactggcggaccagcacaccaccatgatcatcgtcacccacgagatggcgtttgcccgcgatgtggccgatcatgtcgtgttcatggacggcggcaccatcgttgaggagggcacgccgacagaggtatttgaaaatacgcataatgagcgaaccaaggcatttttgagccgtttttcgcaaaacagctaaagaacggaaaattatacaaaaacttttcggtacttttcaccattaccccatttacaaatcacaataaatacgttaaaatagtcccgtaataagattgcgggactttttattgtctttttgtacaggtttagttggtcaatttttgatgaaattattgtttgtttgtgttgaagttttggcgcaaatttgctacaataagaacacaggaaaaaaccaccctgtaaaatcatgtaataaaaagccgcacggccttttataaaatttttgattggagatgtttctactatggctatggatgctttcagcgcctccctgatgaaggacaagagagagatcgtcattgccccgactatttacaagtttgacacctttggtgctttcgctgaggagttcaagctgggcgagcgcgacgtcgttctgaccaacgaattcatctacaagcccttcatggaagagcttggcctcaagagcaagttcgtattccaggagaagttcggtgcaggtgagccttccgaggctatgatcgagaccatgtacgaggctattccgtacgattcctacgaccgcgtaatcgcagtaggcggcggtgctatcatggacctttgcaagctgctcggctgcaagcgcccgacctccgtacatgagctgtacttcaagcgcgagcctgttgtacatgagaaggaagttatcgctatcccgaccacctgcggtaccggttctgaggttaccaacatttctgttgctatcgttaaggacgagaaggacggcaagctgaccggcggcgataccaagctcggcctggtttccgacgacatcatcccgaacaaggtttgcctggttccggatctgctcaagaccctgccgtacaagccgttcgcagcatccgctatcgatgctctgatccacgctaccgagtctttcctgtccccgcaccgcaagaccgttacctccgagatgttctccgttaaggctatggagatgatcctcgagggcttccgccgcatcgctctggaaggcccggacgctcgtatggattacctcggcgagttcgttcatgcttccctgttcgcaggcatcgcattcctgaaggctggctgtgcaaccgtacacggcatgtccttcccgctcggcggcacctaccacgttccgcacggcgagtccaactacgctctgttcggcaagatcctcgagatgtacgacgagtacgagccggctggcgagctgggcaagttcaaggaaatcgttgctcgctgcctgggctgcaccaaggacgacgctctgcgcaccctgaacgtaaccctggagaaggttctgcacctgaagccgctgcatgagtacggcttcaaggaagaggacgttaaggcatttgcactgtctgttgatgcaaaccagcagcgtctgatcaccaactcttaccgtccgtggagcatcgagctcagcgagcgcgtatacaaagagtgcttctaatttccgcatgtaacgcctgaatagggcggggagtcccgtctccccgccctgttttctttattcatgttatgtgtaccaaattgtaatgagaaaggatacttgatcacttatgatgaccaaagaccagtacattgagtccctgcgcaagctgaacctcaatctgtatatgttcggcaagaaggtagagaatccggttgacgacccggttatccgtccttccctgaactccttcgccgctacctacgagctggctgaggacccgcagtatcaggatctgatgactgccacttcccacatctccggcaagaagatcaaccgcttcacccatatgcaccagtccaccgacgacctgatcaagaaggttaagatgcagcgtctgctcggtcagaagactgcagcctgcttccagcgctgcgtaggcatggacgctatgaacgctgtattctcctccacctacgagatcgacgaggcttgcggcaccaagtaccacgagaacttcctcaagttcctgacccgcgtacaggatgaggacctcgcagttgacggcgctatgaccgacgttaagggcgaccgttccctcgctccgtccaagcaggctgatccggatctgttcctgcacgttgtagagcgcaccgctgacggcgtatacgttaccggcgctaaggctcaccagaccggctttgtaaactctcacgaggttctggtaatgccgaccatctccatgcgcgagggcgacgaggactacgcgatctccttcgctgtaccgaccgattccaagggcatcaccctgatctacggccgtcagtcctgcgacacccgcaagattgaagagtacaacgacatcgacgttggcaacaaggtatacggcggccacgaagttctcgttatcttcgaccgcgtattcgttccgaacgaccgcatcttcctgaacggcgaagttaagtttgccggcatgatcgtagagcgtttcgcaggctatcaccgtcagtcttacggcggctgcaaggtcggcgtaggcgacgttctgatcggcgctaccgctctggctggcgagatggctggctcctccaaggcttcccacgttaaggataagctgatcgagatgactcacctgaacgagaccctgtactgctgcggtatcgcttgctcctctcagggcaccaagaccaaggcaggcaactacctgatcgacctgctgctggcaaacgtctgcaagcagaacgttacccgcttcccgtacgagatcgctcgtctggcacaggatctggcaggcggcctgatggtaacccagccgtccgaggctgattaccgcaacccggagctcaagccgtacatcgagaagtacctcaagggtgttgcttccgttccgaccgaggaccgtatgcgtctgctgcgcctgatcgagaacatgaccatgggtactgcagctgtcggctatctgccggagtccatgcacggtgcaggctcgccgcaggctcagcgcatcatgattgcccgtcagtccaaccttgaaatgaagaaggaactggcaaagaagattgctcgcatcaagtaatctctgagcaaactataggcactcatggagcacccgtgagtgcctgtgtttgcgttataccatactgttcccatatggaaacatcttgaaaggggttgtgcgccttgctgcgctgcacggtaaaattctgcggcggctgcaatccgcgctatgagcgcggagacgcctacaaggcgatttgcgctgccctgcaggacaccgcctcattctcctatccggaggacggtgttccttatgacgtactgctgatcctgcgcggctgcaccggctgcccgtatctctatgaggagatcgaggccgcgcaccgtgttgttgttgccgcagcggatgagattccgcaggcgatagatagaatcaggtctttcacgtcacaggcgtgaccactgtaaaaccggtcgcactattatcaggaggattgataaacatgaagaaagtaagcatcatcaccccggaggaagctgctctgaaggttcaggacggcgataccattgctaccggcggtttcgtatcctgtgcttgcccggagaccctttccaaggctctcgagaagcgttttcttgagaccggccacccgcagaacctgaccctgttctttgcagccggtcagggccaccgcgatggcaccggcggtgaccattacggccatgaaggcatggttaagcgcgttatcggcggccactgggaccgtgctccgaagctcggcgagctggctctgaacaacaagatcgaggcttacaacctgccgcagggcgttatctcgcacatgtaccgcgatatcgctgctcacaacatcggcaccatcacccacgttggcctgaagaccttcgctgacccgcgcaacggcggcggcaagctgaacgacgttaccaaggaagatctggtaaagatcgttaacatcgagggtcaggagcgcctgctgtacaagggcttcccgatcaacgttgtattcctgcgtgcttcctactgcgatgagtacggcaactgcaccgtacatcgtgagatcggtcctctggacgtaactgctatggctcaggcctgcaagaactccggcggcaaggtaatcgttcaggttgagaagatcgtacagggcggctctctggacccgaagctggtcgctatcccgggcatctatgttgactctgttgtagtcggcaccgaggaggagaacatgcagtgcctcggcatgccgtacgacggcgcgctgaccggcgagttccgcatcccggttgacgctatcccgccgatcccgatggacgctaagaagatcatcgcccgccgcgctgctatggagctgccgcaggacgctatcgtaaacctcggcaccggcgcaccggagaagatcgctaacgtagctgctgaagaaggcatctccgacaagatgaccctgaccgttgaggcaggctccatcgcaggtgtaccgtacggcggcacccagttcggcgctgctgctaacgcacagtgcatcatcccgcacaacgtacagttcgacttctatcagggcggcggccttgacgttgcattcctcggcctggctgagactgctccgaacggcgacctgaacgtatccaagttcggcacccgtctggcaggtgcaggcggcttcatcgacatcacccagaacgccaagaaggttgtttactgcggcaccttcactgcaaagggcctcaagactgagtgcaaggacggcaagctcgttatcacccaggaaggcgctaagaagaagttcgttaagcaggttgagcacatcaccttctccggcgattacgctaacgaggtacatcagccggttctgtacatcaccgagcgctgcgtatttgagctgcgtccggaaggcgttaccctgaccgagatcgctccgggcatcgacctgcagacccagatcctcgaccagatggaattcgttccgaagatggctgacgagatcaagaccatggacgctcgcatcttccgtgacgagctgatgggtctggctaacgactgatcaattctatttgtgcagattatgcaaacggaaaccggccttttcatataattttacagaatcgaccagtttcccttgcattctgccgaatggtttgataaaatattaacgaactcaagaaaatcgagtttccatcaccatgcggcggcatagttttttcgccgcatcagtagaaaaggagaaacagctaaatgaacgtttacatctgttccgctgcccgtactgcaatcggcacttacggcggcaccctccgcgatgtacactcctccgagcttggcaccgctgctgcaaaggcagctatcgagcgtgcaggcgttgacaaggaagcaatcgacgaggttctgttcggtcaggtactgcagggcggcgtaggccagaacgtagcacgtcaggtttgcctgaagtccggtctgccgatcaccaccccggctatgaccctgaacaaggtttgcgcttcctccatgcgtgccatctccctcggcacccagatcatccgttccggcgagaacaagatgatgctggtaggcggctgcgagtctatgtccggtgctccgtacatctcccgcgatacccgctggggtgctcgcatgggcgacaagaagctggtcgacatgatggtatacgacggcgtatttgatgtattcaaccagtaccacatgggcatcactgcagaaaacgtagctgaaaagtacggcatcacccgcgagatgcaggacgagatcgctctcgcttcccagcagaaggctgctgctgccatcgctaacggccgcttcaaggacgagatcgttccgatcgaagttaagaagaagaaggaaacagttatctttgataccgacgagcatgtaaagccgaacaccactctggagatcctcggcaagctgcgcccggcattcaagaaggacggcggcaccgtaaccgcaggcaatgcttccggcatcaacgatgcaggcgctgcaatgatcatcgcttccgaggagttcgttaaggcaaacggtctcaagccgctggctaaggttcgtgcctggggctctgtaggctgcgatccgtccatcatgggcgtaggcccgatcgagtccacccgtcaggctctgtcccgcgcaggtctgaccgttgctgacctcgacctgatcgagtccaacgaggcatttgctgcacaggctgctgctgttaaccgtgagcttggctttgatatggacaaggttaacgtaaacggcggcgcaatcgctctgggtcacccgatcggtgcagccggctgccgcatcaccaccaccctgattcacgaaatgatcaagcgcgacctgaccatcggtctggctaccatgtgcatcggcggcggtatgggcgaagctatcatcgttgagcgcgacgagctctgcaagtaagtcttgctatagggggcttcaaaagccccctatataccaaaatcagttccgtagaaactgatttgggatacccgaacgacgccgcccagggcggctgggtcggggtgtaaaaacccacgcgcatgtcgcgggtttttacgaacagaagctcgcttctgttctattttgactgcaaacatcctttggatgtttggtaatctccgaacggagattgcttttgagcgttttacgctcatagcacatattctgaaaggaagtcttaaaaatgactgacgtagtaatcgaaaaaaagggtcatgttgcgatcgttaagatcgagcacatgaaggctatgaacgctctgtccaccgacatgtacgcacagctggaagaggcattcgacgagctggctaaggatctggacaacgtttatgcagtagttctgaccggttcttccaccgttaacaagaagggcaagaccgttaactccttcgttgcaggcgctgacatctccgagatggctaccaagacctgtgcagagggcaagctgttcggcaacgagtccaaccgcgtttgctggaagatcgagaacttcaagcgtccggttatcgctgccatcaacggcttctgcctcggcggcggctgcgagctggctatgtcctgcgacatccgtctcgcttccgagaacgcttccttcggtcagcctgaagttggtctgggcatcaccccgggctgcggcggcacccagcgtctggctcgcttcgtaggcgcaggcaaggctaaggaaatgctgtacaccgcacgcgctaactacaccgctcaggacgctctgaacatgggcctggttaactacgtatatccgctggagaacctgctcgacgaggctgtaaagctggccgaggagatcgctgctcaggctccgatcgctgtttccctggttaaggaagctgtaaacgttggcatgcagaccgacctgaactccgctctgaagttcgagggcaactgcttcgcacagtgcttcgctaccgaggatcagaagtacggcatggcttacttcctggacaagaaccgcgacaagccggctaaggaattcaagaataagtaagcattgatacagcaggaccgcacaattcaaaaccggattgtgcggttttgactaatcaatattcgcaatacctgttcatccatccgcaaagagtgagagagagaggttaattttagcatgaaagtttgtgtattcggcgctggcaacatgggcgcacgcatcactgaggtattcctgaacgcaggtcatgacgttaccatgatcgacatcaagccggagttcaccgagcgcggcaagaccgttatcacacacgattacgagttcctcgtaagcaagggcaagatgaccgcagagcgcaaggacgagctgctcgcttccctcaagacctcggttgaccgcaaggacgctgccaatgctgacttcgtcatggaagttattctggagcgcatggatctgaagaaggacctgctggaggatctggacaagatttgccccgctcacaccatcttcgcttccaacacttccggtctgtccatcaccgagatggctgcctgcatcccgcagcgttcggacaagttcatcggctgccacttcttcaacccggctcagatcatgaagctggttgaggttacccgcgcgatccagacttcggacgaaaccttccagaccgcatttgacctgatggcatccctgggcaagaccccggttgccgttaaggaaggtcccggtttcgttgtaaaccgcatcctgatcccgatgatgaacgaggcaatgggtatcgttgctgacggcatcgcttcccctgctgatgtcgacattgctatgcagcttggcgcaggcatgaagtccggcccgctgcacaccgctgaccttgttggccacgatgtaaacctcgcaatcatggagacgctgtaccgcgagaccggcgacccgaagtaccgtccgcatccgctgatgcgtcagatggttcgtgccggctggctgggcgttaagaccggcaagggcttcttcgactatgatggtcctttcggcaaggagatcgtaaagaagtaatcgctttgcaatatgaaaagcatctatgcttcggcatagatgctttttatattctcagcctgtattttttgcatattgcacaaagaatacaagtaatgtttatttaattcgctattttttgacataagctatggtaattttttaacatacacgatataatattaactgtatgggaaatataatctaaccaatgctgcagaggcggtaaatgctgccacatcaccgcacaatgccgcaaatacagcatatctggttcggtttaaaccaaggtgcccgctgtacacgctgattgtgtacaggctggtttccgaggctcccagcatcactgcggccacgcgtccggcatagctgtccggtccgcagcgtcgtataatttcactgcccatcgccagtcctcctcctccgctgatcggcttcagcagggtcagggctgtgcattctttcggtatgcccagtatacgcagtgcgggcgcgagcacgcttgccgcaatatcaacggcacctgaggcgcgcagcatgaacacgactgtcagcatcccgaccataacaggcagtatctgcaccgcggttttcaaaccgacggctgcaccgcgcagaaaagttggaaatacgtccacgcctttgcacagcgcatacaggctgattcccgccaaaagtgccggaatgagcgcgttctgcaaaatctgcaacaatctccctccttgtattatttccctcgtttggaaattttttgagaattgtttgcttattcgacaaatttcttgcttttcatgtgtgataatactacttgtaaggcgcacttacctgtcccgctattccccatccggaaaaaaaggacgcagcagcttgctgctgagcagcaccgccgcaacggaagccgcagaagctccccacaccggcagcataatatcaaatggcgcgtgtgctccgcaagccgcacgaaccgccgccaccgtagacggaatcagctgaattgaggttgcgttcagcacgatcagcgtcaacacggtatccggcgctccgcgtcgccctgcaagaacatacagccgctctgacgcacgcaatcccaacggcgttgccgcgttggataaccccagcaaatttgccgttacattggcgcttaccgcttccatcgcctgtttatcctgcgatgcgcttccgaacaagggacgcagaacaggagccatcagacgggacagccgctctgccagtccggaagcctgcagcagctccatcacaccgctccagaagcacatcagcccggtgatactgatcgccagcgtgattgcttccgcagcccctgtgggtaccgctgccgtaacctctgccagcctgcctgtgaccgcaccgcatagcagcgccatacaaaggaacaccgtccagataacggacagcatatcgtgttcccccccttccgtccaacatcccgagtgagtgggatttggtaatacattttttatgataaagaaatggagtgtgttgaaaatgaaatccaccggtattgttcgtaaggttgatgaacttggtcgcatcgtgctcccgattgagctgcgccgcactatgggcatcgaagtaaaggacgctctggaaatctacgttgacggcgatcatatcgtcctcaagaagtacgagccgtcctgcgtattctgcagtaacgcaaaggacattatccacttcaagggtaagaatgtctgcagcgattgcgcgcatgagctcggcctgctttaagcctttatacagcaacactgtcacgctgcttctgtttgccgactttccgcttggaaagtcggtttttttatttttcaccgcgtcgctgcgccgcttcggcgcggtatttcgcctgtgttgctctgccgccgcgtatgtgccgctcctgcttgttcacctgcagaacggtctgtacgcgctcatacagctcggtattcagcttttgcaggcgcgttgtgatatccttatgtacggttgacttggatattccgaaccgtgccgcagtctgccgcacggtggccttctgctcgatcatgtactgtgcgagacggatcgtgcgctcctccggtaagcccttcaccgctgtttccctcctgcctgatgaggtttcatctgtgacagtgtatgtggattcggagacggttagaacgtgtccgttctgtttttcgggtaaaagaaaagcgctgctattgcagcgcgcagtctgtcaaaaaaagtcgtatagtcagcatttcgcgcggcagcgcgcatgaaacagcatttgctctgcaaatgctcaaaaagggtgagcatgtatcaccctttttgaacttctggagggagaaagtttctgtataggaactttcggacgactttggaacggcccacggtccgttcctgcttgtcggcgaaactgtagtttcgcgacagcctcagcgctgctattgcagcgcgtgcattccctgtgtgtgataggtgatcagctgattcagtccggcacggacctcgctcgggcgaacgcggttcttgaggatatgcaccgtcccgtccaccagattgcgtgccatgatctgcgccatcatcgggctgttctcctcgtcagccagcatgggcacgatcttagacgcaatcagctcaatcattaccggccgcaggttttcatatcgagtgccgttggcctgctccatgataagaagaaggccgtatttctccgccagcagcagtgagagtacctcctcggtgagcagcatgcggaattcctgcgcgtccatgttcaggtcaaaccgcatgctgcgaaagcgcaggatcatgcgcttcaggccgtctgcagcgctgtcggtcagctcgtagaacagctcctccttgtttttgaagtagtggtagaggttgctcttgctgatatttaccttgtccgcgatcatctgcagtgaggtgcggtcgtacccgcgctgcaggaataaatgctcggattcgagcagaattttgtgtcgaagttcgtcttttagtacctgcacaataaggaccacccgttcgtttcttgcatttattataaaacagggcgacataaattgtcaagaaagcataaaaaattgagaatggagaattaacgcaatgggttaatttttcaaaccagttgcaaacgcgtacccgtaggggcgaccagtggtcgcccaccaaccgatatgatgtagcgttacacgggcggccactggccgcccctacggttaggcaatatgcagttcggataacgcaacggaaaatgcctgattccacgttcattttccattctcaattctccattttcaattcttctccatcgaaaaagcaaaaaagaacccgatttctcgggttcttttgctttgcacttacgcgccgaataccttgaggacaaagcctgcggcaacagcggagccgataacaccggctacgttcgggcccatcgcgtgcatgagcaggaagtttgccggattggccttctggccctcaacctgcgaaacgcgggctgccatcggaacggcagatacaccggccgagccgatcagcgggtttaccttgccgccggtcagcttatacataaccttgccgaacagcaggccgccgacggtcgagaacgtgaacgcgatcaggccgaggatgatgatcttgatggtctcccaggtcaggaaggtggacgcaatcgccttgcagcctaccgacagaccgaggaagatggtgacgatgttgcacagcgcgttctgcgcggtgtcgctcaggcggtcggttacgccgcactcacgcagcagattgcccagcatgagcataccgatcagcggagcggtatccggaatcagcaggataacgatgatggcaactgcgatcgggaatacgatcttctcggtcttggagacctgacgcagctgctccatcttgacctcgcgctccttcttggtggtcagcagacgcatgatcggcggctggataagcggtatgagcgccatatacgagtacgccgcaatagcgatggcgggcagataatccgctgccagacgggatgcgaccagaatggaggtcgggccgtccgcaccgccgatgatggcgatggctgccgcaactttgcccgggaagccgagcacaagcgcgagcagaaatgcggagaagataccgagctgtgccgctgcacccagcagcagcgaggacgggcgcgcgatcagcgggccgaagtcggtcatggcaccgatgccgaggaagatgatggacggataaatcgcatgctggacgccctgatagaacacccacagcataccgggactggaaccgtcaaccggtgcattgagcaagccggtcagcggcaggttggccagcagcatgccgaatgcgatcggaacgagcagcagcggctcaaactttttgccgatacccatgtacagcagcacgcatgcaatgatgatcatgattaggctgcgcgggtcctccgcgaaggacgcgaagcccgagcttgccagaatgctgcctaatgcaccgaaaaacgaaaattgcatagtacgcgcctcccgttacatcgtgcagagtgctgcgccggtctgtacggaagcgcccttctgtacgcagacagagccgaccgtgccgtcatgcggtgcgcagatctcgttctccatcttcatggcctcgagaataaacagcacatcgccgcccttaacggcctgacctgccgtgcatcggatatccagaatggtgcccggcatgggcgctgcgacggtctcgccacctgcaggcgctgctgcgggtgctgctgccggagccggcgctaccgcgggtgccggtgctgctgcagccggtgccggtgcgggagccgcgccggtcggaactgcgcttaccgaccccttttctacttctacttcaaactgcttgccgttaagcgatacctgatatttcatgtttcttttctccccttaaaccgccttgatggacttaaatacaagctgatcgagcggaatgcccgtttcgtggctgacgatagccataacgcaggccgcctccacctcgctgacgccttccagcttgacctgcggagcaggtgccggtgctgctgccggagctgcagccgccggagccgctgcaccgaccgaagccggatgcgcggtgtgcttttcgagcgcgcccatcacacgggaaataacagcgatgacaccccagagaagtgccagcatcaaaaatacaataacgataccggacagggcgatcatgagcgcgtccagtacgctaatcggatcgtgtaccatgctcacttaacctccttgaacgaatagcttgcggtgaaggtctgttcccgacgctcaaagaactgctctgcctgctgcgggaatgcgatataggacaggacgtcctcttcactgcgggcatgcgtgccgagatgctcgcgtgcagccggaaattccggctcaagcgtatcggcaaagcggccggtcatcggctgctcgtcgccgagcacctgcttggcgagttcgggattgacttcgcccggtgccttgccgtattcgccgcggatgtagctcttgatctccttgccgatcgacttgtaacggccgccgaggagaacgttgaccgttgcctgtacgccgaccatctgcgaaagcggcgttaccagcggcggataacccatatcggcacgcacgcgcggtgtttcggcgagtacctcatcgagacggtcgattgcgttctgtgccttcagctgtgccaccagattggacagcatgccgcccggaatctggtagatgagcgcatccgtcttggtggacagaacgtacgggtcaaaggtgccgtttgcagagaacttatccttaaccggaatgaaaaattcgttgatcctgttcagctcgtgagcatccacgccacagtcgaagcccatctgctgcagcgcgtagaccatggactcggttgccggctggctggtgccgcccgacatgcacgaggtcgcacagtcgatgccgtccgcaccggcttccgctgccttcagataagtcatataacccagaccggtggtcgcgtgtgtatgcacataaaccggaattttgatgttctgcttgagtgcggtaaccaggtcatagcactcctgcggagacatgatgcccgccatatccttaatgcacagcgagttgcagcccatggcttcgatctgcctgccgagcgaaacgaacatctccagattgtggatcggactcagcgtatagcagatacaaccctgtgcatggccgcctgccttgagacattcgtccacagcggtctcgatgttgcgcagatcgttcagcgcatcgaaaatgcggatgatatccatgccgttctcgatgctcttgcgaacaaaacggcgcacggtatcatccgaataatggtgatagccgagcaggttctgaccgcgcagcagcatctgcagcttggtgttcttcatgtgagatttgatcttgcgcaaacgctcccacggatcctcatgcagatagcgcaggcaggaatcaaaggtcgcaccgccccagcactcaatcgagtgataaccggcctgatccatctcatcgagaatgccctcgaaatcctcaaacggcattcgcgtcgcaatcagcgactgctgcgcgtcacgcagcaccgtttcggtgatgtgcatttgtttcacaagtatgccccctccttcgggaaataaatgggtttcgtgattcccctcattaaccccatatatataattgtatcatatcactttctgcacccgcttgcaagattatgattttctaattttgcacagctgcactttacttttttcaccgcattcggaattgactttttgctctcaatgcagtaatataaatatatcgcgtgctgtgattccgcacgaaagagccgctcgcgaaaacttttgtttttatgtctcagtagctcagttggatagagcacatgcctcctaagcatgtgttttatcacagagaattttctcttgtcacgggccgttgttagatcaagatacgaatggattttggagtttactcgttctggaccgcaaaaaaacgtgaaatatgacgcgcaacaaaattgtcctttaaatactgcatttcgcgcaaatcacactatttttaatacctgtctcagtagctcagttggatagagcacatgcctcctaagcatggggccgagggttcgactcccccctgggacgccaatcaagaacgcagaagatatatttctgcgttctttttctctaacaaatttcaaaaattctgtctaatcgtctaataaaaccgcgatttttctaataacacgcgccattttcggttgttttgaacacaaaaagctgctaataaatggtgtgtgacagcctgttccctgctgttagcaggagactgtctgatatcacttttaacataaccctgtggtgaaattttcaacacagggtttttattttatccgaaaatcatttgaatggaggcaactaacgtgcaaaaaaacgtcaaacctcacatcgttctgatcgatggagtcaagtattacagcgacaagcccgagacctgccgcagctgctttttctggaaaaaccgcaaggttccctgcattctcgggcaggaaaactgctactatctcgctgaaatcattcagtctgaacagcagaagaagtgcgagggctgctgttacgcatccggccgctcctgcgtgagtgcgacctgctataaggatttgatgacgcagttcaacgcatcaaaaaatacaaaaccaaaggaaggtgccgcaaatgactaaacacgacgataatttccgtcgcttcgagcggatggcaaaatccgcaaagaagaatttgtccggggataagcccagcagctgctcgcgctgtctgtactatcgcccggattttaagttccgtttctgtcagttcacccgctgtccctatgaattaaaggaaaatgtgtttcgccgcaagccgctgactcgcgacaaattttccggcaagggaggcacataaatatgtccgcaacgatcattgccgtcgccaatcaaaagggcggcaccggcaaaacgacgacctgcgaaaatctgggcatcggtcttgcgagagaaggcaagcatgtgctgctcgtggataccgatccgcaggcctctctcaccattgccctcgggcatccccggccggatgatctcccggtgacgctgaccgatttaatgacgaacgtcatgcaggagcgccctgtcaaccccgaagaaaccattctgtcacacacagaaggcgtggacctcattcctgccagcattatgctgtccggccttgaagtctcgctcgtaaacgcaatgagccgcgaaaccgtcttaaagcaggttttagagtcggtaaagtcgcagtacgattacatcttactcgactgcatgccctccatcggcatgcttaccatcaatgcgctcgccgctgctgatcaggttcttattccggttcaggcgaactatttgtctgcaaaaggtctcgagcagctgcttcagaagtctttgataaccctcccatctaagagagcacccgtgattaagtgctctcttttcatctgctgatcgttgtggtatgtttaatattgcatattgttatgtacacagtgcgtctattttccccgcatcgtggatgaataggcgctctttttcgtgccccaaaccgtgggcaaatacaagagattggatgttggccatcaataaatggtttgattttcctcgcggtttagagtacaataaaattgttgaaattgctcaaaacagttcaaggaataatacctattacgaattgcgatatcacacaggagacgtctttcatgcttaaacaaggcctttacgagcaagtggtgaataccgaaatcaaagatgagctgcgtcagctgccggaaaacagcaagcacgtcgagaaaatcgacacagccgagtcctcctctgtcttaacgcagtacctgtccgaagtcgttcacaaaggtcttgaccgcattgcgggtgacgatatttctgcgcagctaaatctggtcaacaaaattgttgatctgatttcgcaggagacagcgcaggacgacctgcgtgattttactgtggacgatgagggtgagcagttattcgcattgctgtcccgcgatgatcctatgatgcgcatcggccggaaaaaagcaaaggatctcccccgccctgaaacatcgattgctcaaagcagcttatttaccggagcagttcacgagccgcagatgttttccgagctgaagaaagaaatcgcctccgcagaccgcattgatatgctggtttcgtttgtcaaatggagcggtcttcgtttaatcatcgatgatcttcagcattttgcggaacgcggcggcaggctccgcgttattacgacaacatacatgggcgcaacagacgtgaaagcggtggaggtgcttcgcaatctccccaacacggaaatccgtgtatcttacgataccgagcgtaccagacttcatgcaaaggcgtatatgttctatcgtgaaaccggctttaccacggcgtacgttggttcttctaacctctccaatccggctatgtccagcggactggaatggaatgttaagctgacaaccaaggatatgctgccgaccattcagaagatggaggcaaccttcgatagttattggaacaccgccagctttgaagtctatgagaacgggtgcagggaaagactggagcgtgcactgtcaacaaacggaaaagccaatccgacaagcgagatgcagttcgttttcgatattcagccctacccctaccagcaggagattttggatcgcctgcaggcagagcgcgaggtgcgtggctattgccgcaatcttgtcgttgcggcaaccggcaccggcaaaaccttaatctccgcctttgattaccgacggttctgcaaagccttttccggttcgaagccccgtctgctgtttgtcgttcatcgagaggaaattctgaaacagagccgaagtgctttccgtgctgtgttgaaagatcccaatttcggagagctttttgtgggcagcttcaagccgagcagcctggagcatctatttatttcggtgcagacattagcctcccataagctgtatgacgttctcccggaggactattacgatttcatcattgtggacgagttccatcacgcagcagcgtccacctatcaaggactgctgaaccacttcaagccgaaaatcttattgggtctgaccgcaacgccggaacgcatggatggaaaaaacgttctggattacttcaatggccgcattgcatctgaaatccgactgccggaggcgatcgagcgcaagctgctctgcccatttcaatatttcggcgtttccgatgatgttgacctgtccaatattcgctggacgcgcggcggttatgataaagctgagcttaacaacgtattttctctgaaccgtgctgtcgccgaaaagcgcgccggccatattgtcaattctctctatcggtatgtaaccgacatcaatacggttcgcggtcttgggttttgcgtctctgtcgagcatgctgaattcatggaggaatatttctcatcgaaggggatcccctgtatgtcccttaccggtacttccagtgataaggaacgaattgaagccagacagcgtctggtctccggtgaaatccgctttatctttgttgtagatttgtataacgagggcgttgatattcccgaaattgacaccattctctttctacgtcctaccgagtcgctcacgattttcctacagcagctcggccgcggtctgcgtctctcggaaggaaaagaatgcctgaccgttttggatttcatcggtcaggcaaacaagaaatacaattttgaagaaaagtttgctgcactgctctctcacagcaatcacagcatgcagtacgaggtgaaaaagggctttgtatcactgccgaagggctgctatatccagctggaaaagaaggcttccgaagtcattctggcgaatattcgccgctccttcggtgaccgtgccggtctgattgcgcgtatcgaaagcttcacacaggacagcggccttcccctttccttgaagaatttcatcgactactatcacctcgacccgcggtcgatctacggtaaattctccttctcccgtctctgtgcagatgcaggcgtccttgatgattttatcgaacctgccgaaagcattctgacaaaggcgttcagcaagctggttgccgtggattcccggcgctggattaagttcctgacggatattcttccgcgcttctcctgtgaacttgcggcttcgctttccgattttgaaaagcgcatgctgcaaatgttctacatcaccgtatttcaggaggcggcagactggcgttcccatactacgcaagccaatatgcagctgctcgcggacagtccgatcatgatgcacgaactgaacgagcttttgtcgttcaatctggaacgtattgactttatcgatcagcctgtcccgcttggctttgattgtccgctggacctgcattgcacctataccagagatcaaattctgattgcgatggactatatgacgccgaaaaatgtacgggaaggtgtcaaatggctgccggacaagcaggttgatgtgttctttatcacactcaacaaggcggacaaggactactccccgactaccatgtacaacgactattcgatcaacgaaagcctgttccattggcaaagtcaaagcacgacctccgatacggcaagcaccggtcagcgttatatcaaccaccggcagcgcggcagcaaggtcgttctctttgtgcgggagttcaagcaggacagcattggcgctgcaccgtatacctgtcttggcacggcagtctatgtgaagcacaccggcagcaagccaatgaatattacatggcatctggaccagccgattccggcgaagtatcttcgcaagacgaacaagctggtagtcggataaggaaggcattttatgaaaacaatccgagtggtcgccgcagtcattcgtgatggcgaaaaaatctttgccactatgcgcggctacggtgactttaggggactatgggagtttcccggcggaaaaatcgagtctgacgaaacaccgcaggaggccttaaaaagagaaatccgggaagaactggcctccgagatttcggttggtgagttgattgataccgttgaatttgattatccgacctttcacctttcaatggattgcttctggtgtcagctgattcgcggtaatcttgaactgttagaggccgccgaagcgcgatggctgaccaaggaaacactgaaaagcgtggattggctgccggctgattccgggctgattgaaaagattgagaaagcgctcgctttgctgccatcttgaactgtaatgcaaggcggtgcagccatcatctgcgaagcctttccggactgatgcatttattcgttaatcagacagcaatcacatgaatgttgcaagaggagcattactttgacccatcttttcgccctgtccacagcggccgccgatattatgaatatttcgcttcgttcccgcctgtccgccgcgcggctgacgtatatcgacagcctgcacggcacctcccgtcaacagagcttcaccgcttccctgctgctggatgaggcaatccgcctttgctgtccgtccgtgccgcgcccgctcgacattgccgcgaacgagaacggcaagccgtatctgaccgccgcgccggatgttcatttcagcctgtcgcattccgccgcatgggcagtctgtgcggtgagcgaccacccggtcggcgtagacattcagcagtgccgctccttcaaacccaatattgccgaccgcttcttccaccccgatgaggtgcagtacctgtcctcgctctcgcctgccgagcgcgaaaacgcgttctacacgctgtgggcgctcaaggaaagctacgtcaaggccgacggccgcggtctgcggctgctgcggcagttctgcgtcgatatcgcctgtcagccgccggcaatcaccgtcggcacacccggctccctgtttgtgccggatttccccgatcccgcctacaagctcggcgtatgtgtgcaggaagaacactccgaaacacctgctctcactgttttacagcatctatccaccccataaaacgcaaaaaagaaccgataccataaggtatcggttctttgaggctgtcgtgaaactacagtttcgccgacaaacaggaacggaccgtgggccgttccaaagtcgtccgaaagttcctatacagaaactttctccctccagaagttcaaaaggggcgctatccttgcgcggcttctcggccgcgctgcgctgatacatgctccccctttttgagcatttgcagagcaaatgctatttcatgcgcgctgccacgcgaaatgccgaaaaaatgctgactatacgactttttcgacagacagaaagaaccgataccataaggtatcggttctttctgtttattcagactctttcgccttgcgaaccgctgtcgccagctgatccgagcagcttgtgccgcgtccgttgcatgaaatccccttgaagtagccttcaatctgctccacggtcatgccctcgaccacgcggctgattgcctgcagattgccgttgcagccgcccttgaaggatacgttgtgtacggtatcgccgtccagatcgaacgagatgttcatcggacatacgccgtgcggcttgtagtcaaaatgctgcatgtctttccttgtcctccctaactgatcagagcaaagtgcggatatgcgccgctgcctgctcgaatgtgcttacctcggtgtaggacaactcaccgaccggtttcggcttgtccgtccagttgagccacacgccgtcaatgccgacgtcgagcgcgccctgaatatcgtgcgtgaagttgtcgccaaccataacggtctcctccggcagacagcggcatttgtgcatcgccagccagaaaatcgccgaacccggcttatccacaccggcttcctcactcgtaacaaggcagtccaccttgtcggcaatgccgaggtactccagcttttccatctggatatccgccagcatattggtgcagatggccaccttaacgcccgccgcacgcagctcgtccaaaaactcagccacgcccgggcgcaaggtcatcttagcgaacaccgcatcccagtacacgcggaatgcctcgcgcgaatagcgaacggcgttcaggcccatgcgctcgagtgcaccctgtgcaaacagcacacggtcatgcgtaggcggcatggcaggctgctgccgtgccagacgcttgcggttgacgcggaatgcgtccgcaaaccccttgcctttgtctccaaacgtgctgatggcccactcctccagcttttcgtaggcgtaggcgtccccggcctgaaagctggtgtataacgtgtcatccagatcgaaaaaaactgcttttaatcccataaaatcctcacaaaagtttttcgttatagactgcgcggctaccgcctacaaacttcggacggcggcgtgcgcacagcagaacggcttcgccgatcttcttggtctcaatgcgcagcggtacgaccaccggcttgatgtgcatgccgatcagcgttccgccgatgtccatgcccgcagaagcgctctgcttgagcgactcaaccgccaccggatcatcaaagcgcttgtacgcggtcgtgccgaacgaaccgcctgccttgggctgcggaacgacgttgacctcctccagaccgaactgctctgccacggcacgctccacgatcagcgcacggttgaggtgctcgcagcactgtgccgccagttccacgccgtgctcatgcagtacgctgtgaatgccctcgaataccgcttcggctacctctacactggaatgcgtgccgatcttctcgcccaggatttcacttgacgagcagccgaccacaaacaggtcaccgatcttcagcttggctgcctcgcaaacctgctctgccgcctttgcactttgttctctgatttcagaaagctccatttttcatgcctccccttataagagtactattagtataacataaatgtcggaacttgttaagacccaacggcgtatgttgagagtgaggagttaggaggtatcgtgatgatattgcagggcggggtgaatcatgatccactcctatctcctaactcctaccttatacgaagggagaataaccatgcagaatcatttacagaccaaggagagtatccctgccggtctgctttcgcttgcgatggcctttgtgccgacgcaggaatttgatacaccgtatgatccggtgctggcgttctcgcgcggcacgatctttccggcactcgacaagccgtttctcggagaggaggcagtgccgcaatgaccgacaaggccaaactgctcgggcgcgtgcgcatgtacgatttcgcgctcgttgaggtgatcgagtacctcgacggccatccggacaacgctgccgcgctcaaatactacaacgaaatgcgcacggcgtttgacaaggccgccgccgagtacgaggacgcattcggtccgctgaccgcccgcgaggtggatacccgcagcggacactggacgtggatcgacgatccgtggccgtgggaaggagctgaggactgatgtggtcatacgataaacgattgcagtttccggtgaagatcaagaatccgaatccgcagaccgccaaaattgttatctctcagcttggcggcccggacggcgagctgggtgcgtccatgcgctatctcaaccagcggtacgccatgccgtataaggaatgcaagggcattttgacggacatcggcacggaagaacttgcgcacatggagatgatctccgccatcgtgtaccagctgacgcgcaatctcacgcccgagcagatcaaggagggcggctttgacgcctactttgtcgatcacacgaccggcatttacccgcagtcggcctccggtgtgccgtggagcgccgcaacgttccagtccaaaggcgacccgatcaccgatctgtttgaggatatggcagcggaagctacacctttgtaagaacaatcttttagcctttacgcatcattttagcgtacatactgttcttttttgtgtgttatcatacgtaacatgataaatacatgtcaatttatgataatcgattaaaaattccaatgaatctccacaggaaccgttttcgtgccctttgcgcgccgaccgacagtcacatagtcaatcagcgtatcgaccatctcacgattcagatgctcaatgttcatgtacttctcgaccagtgcacggcggttatctccgatagcgattcgctcctcaagttctcgcatctgcttttcgccatcctcgatcacatgctccagccgatcacgctctccggcaaaatctttcgacatagcaagatagtcctgctctgtcagcagtccctttaccttgtcgaggtacagattgcgaatgcctgttgtatattcctcctgcttctgacgataggtgttgatctccttttgcaggcatttcttctgtttctgcaaattcttgcagaacgctacgctctcggccgcttcatccttatcgagaaattcctgcgccatccggttcagctcttccagtacagcttcctccaaatggctgaccgcaataaacgcaccgggacaggcttccacagagatatgccgattcggacattgcagatagtgccggtcctgcgtcttggaggaccgaagcgtatagccgcaatatgcgcaccgtgctttgcgtgcgaaaataccaatttttccatcactgaacggtctgctgcgctctgctcgccgccgacataccttgtcccacagttcctggtcaataatcggctcgtgcgtaccacgcacaacataccactgatctttcggacgcgacttacactgcttggttttatacgacacactgccatacttgccctgcaccatattgccgatgtaaatttcattttccagcatatccgcaatcgcaaagtatttccacaaggtgctgtttttgctcaccgcctgcttgtagcgtaagccatgctgtcgtttgtactcggtgggattgggaatcccgcgtgtgttcaaaatacgggcgatcgaagttttcccatatccctgtgcaaatagattgaacacctcacggactactgctgccgcttcttcgtctatcagcaaatgccctttgcggtcagggtctttgcggtagccgtacagtgcaaacgcaccgatatgcaaaccgttgacacggcggttggtcagtacgctgcgaatgttatccgacatatcttccagataccattcgtttacaagaccgttgatctgacgtgatttcttgttgcccttattgtccgtatccgcattatctacaatgctgacaaaacggataccccagatgggaaacagaccgtggatatacttttccaccagttccaattcacgggtaaaacgtgactgtgttttgcagaggataatatcgaacttgtgctgttctgcgtctttcagcagccgcttaaactgcggccgccgcctgtctgcaccagtataatcatcatcactgtaaatctgataaacttcccacccctgttcttctgcatactgcaccagcattgctttctgattctgaatactgcccgaatcatcggtcgcacatagcttgtttttatcttcctcggataaacggcaataaattgctgcttttttcatgttctatccctcattcagataagaacaagctgtttcctacttttattgtaacgcataactgcacttttgtcattgccttttctccgtaattttcgtttctgtccgttcgatacgattgatcatctctacccatttctctgtaaatcgtttccggtcgcaggtttcccctccattctgaaaaacgtgtgtgcaaaccgctttgatctgctgttttgccatacggcttcacccttcctttcagaatagcctatgttgctctctgctaatgtaaaacccgcctgctgcaaaacaggcgggttttctcattctactctcaaatccaatattcgttgcggtcgctgtccatgatgaaatcatgttcgtgcgaaacctctgtcacaacagacgagggcgcatccgcccatgtacggagattgccgctgtaatcggaaacatccggcgaggtgtcgcgtccggtaatctggcagattgcctttgcgaacgtcagacgggatacatcaccgttgagaccgatattcgttcgcgtcgcgtaagccaccagcgaattcagctgaccagacgcagcccagatacgcaggtagccgttcttcgagattgtgtagttgatctcgtaatcatcgccctcatccatgcgagcggtatcaaatgcggacgcaggcagaacaccgatggaaacgaaatactttgcttcttccggaatatcgtactggtatttcggaacggtagccgtgccgcgcggcagccatgtgttgccgccgtttgcaatcagacgatatacaacggtgcaggcttcctgcagggatacgcgatcattcggccgccacaggccgtccgcgtagccaccgaacagctgatagtgaatatccgtcagcaccggtgtaccagacgaaacgacttcaatctccggcgaacagcccgaagccgaaccattgtcacccgtagccgcggcaagattggtgtacgtcttgccgcccgcatcggtcttaaactcaaccgtgattttcaccacgcgcttttcattcgaaccaatgtcaccgagctccagagtaaacactttgctccgaaaactccacttgctgttcagaacaccgtccacatagacgttgttcttcaaaacaggcgttaccagtgtggtgtccagtgtatctttgaggataacccgtttccatgtctggttagaatcgttgccaaccgtgatggtaaatgtggcgcgcttgcggtctgccgaaacgccggaacctacattcaccacagttttatcaacctctttggttacataaaaatttgtgttaacgtccggctgttctgccgtgtcaggaatcgttacacccttgtccgttgcagtgccgtgaccgttatcgccatcaagcgaagcagtgttggtaatcgttgtaccagccgcactttcaagcacctgcacgtcaaaagtgatttcagccgattcgcccggttcgagatcacctacgagcacagacagcgcattgccgctcaaatgatacagcgcaaattcgttgttgatatacacgccgcctaccagcttaacaccagtcgggagcgtatcggtcagtacgacattcttccatgcagcagttgccttattgccgttctttgcggtaatggtgtaggtgaaagtatcgcctacattggcagtggtgacgctggcagtcttgttgacaatcggagcagcttcgccctggtcaatctgcacaccgccgtccggcatgggcgtttccttgccgttatcatcgaggatagcggtattgacaatgaacttgccctgcgaaccatcatctacggttacatcgaagctaagaacggtctgtgcgcctgctgcaatagcatccggcgtgaaagtgatcgtcttagtgtcggcgttgtaggagtagtttaccgttgcagaaccgttctcctgcacattgcccgcaaaggttacgccatccgggatagtatcggttacggtcatgttctcccaatcagcggtagctgctgcgccgttttcaaggcgaatggagtaagtgatcgtatcgccaactgctgcggtggtcttgtttgcggtcttattgcccgcatgaccgtctgccgtaccatcctcaatatccacaccatcgtctgtaccgctcttgtccggcgtattgctgccgctgacgagggcggtattttcaatgtgcataccgtaagcatcgctgttgacggttacatcaaagcaaatcgccttggtctggttcggcgcgatctcaccgagcgatacggtcagggtcttgccggtattgtcgtactgatattctgcggagtagccgtctacggttacattgccgcggaaggtcagtccgttcggaatggtgtcggtcattaccgcgtcacggatattcacatccgcaccggtcgcattggcagcgtttacggtgtaagtgatcgtatcgccaaccttggcagtggttttgtctgcggacttggaaacggtcagcagagcgtcaccgtccgcgattgctacgccatcgtccttgtcctgcaccgggtctgcattgtcagaggtcagcgttgcaaggttctggatggtggtgttgtacgcggattcgttcaccgttgcggtaaagccgatgatctgctttgcgtccggctcaatcgtgccgatattgacggtcagcaggcgggtattctcatcgtaggtgtaatcgttggtgttcttgccgttcagcgtgacagagccgtattcaaaggtcagtccagccggaagaacatcggtgataacaccgttctcaaccggaacagttgcggtatcgtcattctttacggtcagcgtgtacgcgatcttatcgccaacacgggcagaggacttgttcgcagacttgtcgatctgcggctttgccttgccgtcaccaacggttacgccgttgtccttgccgctggtgtctggcgcattgtcggacttcatcacagcagtgttgtagatggtctttccgtatgcagcggtattgactactgcaacgaaagttaccgctgcgcttttctcaataccgagatcaccgaccttgacggtcagaacgcgggacgcttcatcgtagctgtaatcgttggtcaacttgccgttcagcgtaaccgagccgtactgaatatccagtccgttcggaatggtatcggtcagcacagcgtccttgatcgctacgcttgcgaactcgccgtttgccagcttgatggtgtaagtcaccttatcgccaacattggcagcggacttgtccgcagtcttggtgacttccggcttggtcttgccgtcaccgatctcaacgcccttgtccttgccctcggtatccttgatgttatcgccggagaggagagcggtattgtgtacggtcttgccgtaagccgacttgttgacggtcacagcgaaagttacagtgcgggcagcgttcggcttcaaattgccgatctgcacagacagcttgcggctggtgttgtcgtagctgtacggataggacttgccatccacctgcacgctgccgtctacgaagtcaaactcagccggaatggtatcgaccatttcagcgttttcgatctcgtaaacagcaccgtcaccgttgccaaccttgacggtataggtgatcttgtcgccgacatttgcggtttccttatccgcagtcttggtcacatacggcgcggtatcgccctttttgacatacacgccatcgtccttgtcctcgtaaatgttggttttcttgccgtccgcagcggtcacataaccgttcgtacccttggcaacagcggtgttatagatcgtctgattgtacatatcaccgttgatttttgccttgaaagtgacagttaccgtcttgccagcagcaatatcaccgaggtttacggtcagcgtgccgttcttgacggtgtgggtagccgctacattgttcacatagacgctgccctcgataaaggtcatgccggacgggattttatcggtcagcacgacgcttttccatgcggagcttgctttcttatcgttcgccagcttgatcgtgtaggtgatctcgtcacctaccttagcgtccttgacgcttgccgtcttttcgatggacgggagcgcatcaccggtgctgtactggtaagtgatcgtgcggatatagccgcgatactcatacgccggaatggacttgggcgcggtttctgccttgcccgccgtagtgacagactttgcaatctctttgccgctcatgtctacgaatttctcaacaataatgttgtacttgccgtcattatacttcgcgtcatgccattcctcggcggtatgggataccgttgcttccatgaggtttgtgtagccccagaacgattctgcaagatcgttgtacggattcttgacattcagttctttcagcttttcgcgagtaacggcacggttaatcatgttattaaccagcgttacggtttcggttcgggtgatctccttgtccggcttaaaagtgccgtccgggtagccccgaatccagcctgcttcactggcagcgttgatatagctgtatgcccagtgacccttttctacatcagagaaaaccttgccgctggtgtatttgaggttctggaaacgagccgccagcgcagcgaactcggcacggctgatcggcgcgttcggcgcgaaagtgtccttggacttgccctccagcagaccgatattgtacagcgtttcgaccggctcatagaaccagttctttgcgcttacatccttgaaagtgccgtttgacatacgccgcgtaaagctgggataatcaccgtcatacaggcggtagaagatcatagcagcttcggcgcgggtcagatcaccgttcgggtgtacgcccttgtcgggataaccgataatgtaggtcaagtccttatgcgaatacacatactcaacactttcggtataatccgcgtaggtgtagtttgtgatcgtctgcggggacttttcctcgtgcgtgacgctgtatgtctgcttttggacaatctccttgccgttttctgcgtcaagatattttgccgtcaccgaggacagcgtacttgcagacttcgcgctgacggcaaacgaacttggaataaccgttgccgccatcgccagcgacaatcccgctgaggtgattcgctttataatcgacattgtttcactccatttccattaagctcaactgccccggcagcacaccatcctgcagccaccagtgcagcacttcttccccgctctgccagacgagcgattgcctgctgttccttattcattgcgccccatgagtttgaagtaggctttgggacgtttcggcagttctgtccagaaaatacagcggccgtacagatcgtgaacgaaactctcacggcctaagtaaagctgtacgtccattttgccgttcggatacaggcacagaacccgatgaccgcgctccggcagtatcttatttgcgtttttccattccatagataacctccaaaagcaaaaccggaggaatccatgcgattcttccggtttgtgattattctgttgtacggatttttacactatcatatatatcatcacctcgcatttctctgtcagcctattcgtcctcacccccggctgccgggaaacatcaggcggtcggcagcgtaccgacctcacaggcattgcacctatctcgttgtccgatctcatagcctgcgacgctttcaacgctcggacggtgactgatcgggagtatcattatcatctatgcgggtcatcgccttgtcgggagccgcccgacagttcgcgactttacgccgcagctctccgcacagaatttgtacctgatgtttgatgttcagttgccaaggagcagtgagagaatatttatcccctcactgtacccccaagaaaaacgcctactgaacaccctgaaaatcagaatttttcaaaatattttttcagatacttcaaaatacgatttcggcgcttaagcattgcagtctgcgtaatacccaatttttgtgcatattctcgggtcgaatagccgtcatagtacagcgctttaatcagctttttgtcactttccggcagtgattcaataactttaggcaactcatccagcatttttgcttcatgttctgcttcttcctcaagcaagcaatattcctccgcactcagttctgcgttttccaacgtttcgatatgtataccatcctcaatcgtgcgttccagcgatatttcgctctctgcgggaatatcctctccgatatatcttgcacgccggtccatctgcgagtatatatcaaatatctcgtctgaaacctctacatcctgtccgaacacggtgatgatgtttgcaactacgttgccgtccttatctttaatccgcttgtagttgcgggttttctgccagtttttcatttttaagctccaatctcaaagtttttgtttgagattggaacttatggatagcgggcaatgcaggcttgccaggaatctataaaagagcgaaatactctgcgctttttgatttgagggcaaaaaaataaagccttccgcatagctattaagctatacaaatggctttgcttcataaaacattttacaaatcaaaacgctactgacaacacccttgattaggattacagtagcgtactgatcaaattttacagatttgaattttttatttcaatatttgtacatccgcctacatattatcgctcacgaaggcattctgaaacttccggctgatacgattcaaacagacaagtagtgcccacagaagcggttgctgcaacaattgccagtgcagtaataatctgaccaccatgcacaatacaccagttgatatacctttcttcatgtagtacaaatgagcacattaccaaaattacaatattcagaattgccgaaacgatcaattctaaaccgtacgcacagatttccaattgttcatccgatacaataattcccttctttttgcgataattacaataagaatcgacaaacttcttcataaaaatactctattctcgcttattcacttcactatacctgatattccttattatatcgagcccttgatatatttcaatgtccttgcagagtttagtcccgtttttgcagtaattagttgaaaagatagtacaactattataaaataatagtataagtcgcttctaattggtatctatactacttaaaataatagtatcgctatacctgaggtgattacagatgataggtcttggagaaattattcaagtcaaacgtaaagagttaggattgacgcaagaacgtcttgctgaaaaaatcgggaaaaccgccggatatatcggccaaattgaacgcggactcagttatccatcttatccggttttattacagttgattgaaacattagaacttgatgtacaatctttattctgcacatcaacactcgaagaaagcgcaaaactgaagcaagaatacgcacaactctattccaaactctcaaagaaacagcaacaattagcccttggaatgttaaaacttatttcgagatgtgatttttaacaggagtatttatgcgaattgcaatttgtgatgatgaagatcaggaacgactcaatatcgaagcattagtcaagcgatatgcccccgaattatctattgtccttttttcctcagcagacgaactgctggcagcagcaaaaacgacatttttcccattgatttttctggatattgaaatggatgatacaaatggctttgatgctgcagaagaacttatgtcggggagctcacagccgcttattgtttttgtaaccaagagcaccgaatatacgattcgtggttatgacgtggcttttcattatcttgtaaaacctcttaatgaggcaaagttccacgaagttctaaagcgcgctttgcgtctgattattccgcagtattttacattctcctcgaacggcgaattgtatcgtatccctgtacaagaaattctgtatttcgagtctcgtaattatatgcttttcgttcatacacagcagcagatttacaaagctcgcttgagcctgaaagaggtcgaaccccaattatcatcagccaattttcttcgtattcatgccagtttcttaatcaatctgcatcatgtaattcgcataacaaaagacgatatagaaatgcaggaccatcaactcatcaaaatcagtagaaaccgaaagaaagatgtcattgcagcttttacaaagtttgcgagggaaaacatatgactttgctaattgaagccctcagtggtgtattagacacctttctactctatctttttgcatctggattttactcaaaatatcgcagcactaaatacaaaggacatttatacttgcttgtaggtatttttattatcgtgatgagctgtatccctatgccgggtatacttcgtatcctacttagctggagcattatcagtgtatcaacatatgcgatttttgaatccactgtttgcaaggcacttttaacttcaacagcatttataaccctcagtgtgttggttgacgtaatatgtgaatatcctttttatctctccggcatttcacgaacggttatcctcggacaggggttagcacgctgcatatttatcatctttgcaaagctgataaacttgctgctcattctttttattgtcacactgttcggcaaaaaaggtttacttgatattccattcaaagaattgctcccactcacgacctgccagctcgtcagtgtatttatctgcattgtatcattggaattggtcggaaccgtatcgcactttcttttaatattattaacactttctattgccggaattttgtacatcaacattgtattcttcgtatatatgcgagctattcgtacaaattacgaaaacgagcagcagcggcgtttggctgaacagcaactcgaaactcagctgtcttattacgaacagatgaaatccgctaacgagcaaacgcgaagcctgtggcatgatataaaaaagcaattaactgctgttactgcattagtcaaggacagtgatatatcacaagcagagttatatctcgaaaccattaccaaatcatttaattcgcttagcaaaatcgttgatgtagaccatccggttattaacgcaattttgaatgatgcactgggaaaatcctcgcttgccggtattactttaaaaatcgacgtttttgtttcccctcagcttgccctgtccccgctggttttaagtgttattctcggaaatacattggataacgcaattcgcgcatgcagcggtgtatctgccgatacgcctaaaatcgtaagtttaactttaagacaaaaggacagtattctgtattaccgcatttccaatccctatgacccagaattttcttctaagaaacgcgagggtattcatggttatgggctgaaaaacgtcagttccacagtagaacaaatcggcggcacaatacaaatcaatcaggagaataatcaatatactgtagagattattttgaatttgtaaaatcatggacgacagttttaaaagctgtcgtcctttctttgtgcattttactgcaccagacctaccaaactctgcactcctattgcgtgcttttctgcacgatgtataatacagatacacaaatcgtttaaggaggtagttcatatgaaaaagcgttttcgcatcccgattatcggcctgatttgctgcctgttgctgggtacgattgctttcgcagtcaatggccgcaagatcactgcaacctatggaggtatcaccatttacctgaacggccagaaacaggtagctaccgatgtaaatggcaaggtggtagaaccgttgatctatcagggtacgacttatgtgccgatacgtgccgtcagcgaatggctgggtaagacggttacatggcagggcagcacaagttcggttttcatcaacgattctgtcttttcggacaacgaagttgcagctgctgaaaatgtaatcagcgagttctttacactgttcggcgataagcaatatcagaagatggctgcgttgtgtaccggcgatgccgcaggttttgattacagctccggcgtattcggtatgaaagaggcaaagttgaaatcctgcacctataacggtgattactccgcaagagaaaagaaactcgtttttgagtgttcttttgcaatgaaacccgccgcaaactcggtgtatgaccctaatcaaaccaacacaacctgcttgatttatgtcaaaaaagtcggcagccagttcttgattgatgaatttgcaagcggtttctaaaccatcattcatacaccagataataaaaggaagaaatggttgtcacaccaactcggtgacaatcatcgagagtgcacttgcatatggagggataaaatacgatgatgaataagtttcaaaaaatgatgagcggcacactcgcgggctgcctgatagcgtccgcgctgatgatgagcgcaggcgcagcaaatgtgcagacctatataccatcgggtacggtgcaggcagctacacagactacaacacagacccgcaccgccgtaaaaatcaatccacagagcgcggatatctatgcagagggcattccggctaccttcccgagcgaggacggcaagacggtttacacggcgctgagctacaacggctcgacctacatgccgctgcgtacggttggccgctggatgggcaaaaatatctcgtgggacagtgcatcgcgcacggtgttcctgtcgggtactacggaaaagtcgtatccgtgtgcggatgacgatgcgtaccacaaggaaggcgtgaaatatgtcggtgcgaccggtcatgctacgctcgataagggcgtaaaggtcctcgtggacggcaaacagcagaccttcaaaaaccagaagggcgtgaccatttatccgctgttttaccagaattccatctatctgccgctgcgcaacatcggtgagctgaccggcatggacgtaacgtggtacagtgccaaggcggagaatgacgtgaacgccatcttcctgcgcatgccgctgagtgacagcaagcgtgccgaaatggaaacctacgcgacaaatctcatgaagcagctgcttgatatgcggacggatacgcagaagatcaagaattgtgcgtctgcggtgaaaaacggcggctataccgactatgtagttaccgataaggcaaccgccatggcggcgctggactccatcaagcgcaaagcgcagaccatccgcagcggcatgaccgagcaggagaatccgatccgctactacaacagcagcctgatgaacgaactggatttcctcatcgataacgcggacgccgtgatggaccgcgtgaagaacgggcgggtcgtgctcggcagcagcaatccggatacgagcgtggtcgatcagaccgctgtcatgttcggcgctgataatactatgctggactgcgaacgcatggttcgtatgctgcggcagaacatggatagacttttttaatgcaaaccaagaccataaaaagctgaggattacctcagctttttatctatccgacaattttccaattcccatctaccagtttcagcacaagctcaaactgcgaaatctgcgtcattttcataacattatccagtattctactgtcacagttaccattacagtatcgctatgcctgttcaacactatgcttttaagctggctgactatatatgtaagcatagaatcattgctaacatagtaagatagtcctttaggttgccgtcggctataatatgaaaaagataatcaagaaatccataacacgcaacgaataataatcaatataccgtagcgattattttaaaaatgtaaaacaacagacaacagctttccaaaacgccattcgtcatctgtgcattttactgcaaaaatcatactgaactctgcattttcagtacaaattccacttttaatggtataatgcaaatatgaaataaacaatttacatactcgattatctttcacaataactgtaaagcattttatagtcttaccagctatatttgagttaaattataatggctattgcaggagaaaagtaatgaaaaagaaccttgccatttcatgtattctattagctgtagtaactatattcagtctgtatttttatcaagagcgcgaaaccaaaagtttacctgcttccattgaaccatacaccgaaaccgcagtaatcttatcagattatattgattttgaaaaaagcatttatatcggtcacaaatccgaccatgagatattatataaaaattacgctgataactatatcaggtcggttgacttaaatacccaagagcaacaggaacttattaaattggacacgcaaacaaacggcaccatgacaacctttgattataaggataattggtttgtctggtccgagagccaagacgccgaactgcgtgtaggaagttctattggtgaaaattgggctgtatacgcggctgacctgcgtacaggagaaatcatattcgtagacggcgaaaacgatttcttccctaaaacacggaattttgacccgcacccgtggtcgctttcggtaaatggcagctttgttgtttacgccagttatacagctaatgaagatggtatttaccctgcaataaaaatttatgatttgaacaatcataaattggaaattgcagatacagcagattccatgcaaaccacttttggttcaccgtctgtgaatgacaaaaatgttgtttatctaaaatatgattctaatggcagttccctttggacatatgacatagaaaaacataaacgtatgtgtatcgagccgcccgaaccgttgcaggaaatatgcatcacaaactcttttatcgtaggcgtttcggagtggcagccgcaaaaatcagaatcgttatactgttatgacttcgctcataagaaatggtcaaaacagatagacgccaccacgaaattatatccaaacaatattgacagcaccttagaatttgctgaactgcaatcttcaaacgattttataacatggcgtccgattactggaaatgcactttatgtgtgggatataacaaccaataaagtattggatttgtccgaaaatgtttctgggttaattgattatgtattatatccttttgatgaagattatctggtttggtgtgaaacaaatacacaaacgcaagaaactaagtatccatgtataaaaatatcaagtgaatcataaaatttctgcgctcgccaccgcgagaatagaaggctcgtctcagaatcgaaacattctgcgacgagcctttttcctcttcggtattcgattttcacacttcgttacttgctacttttccccgtacaaacgcatacatcacccgacgattttccaattcccatccaccagtttcagcgcaagctcaaactgtgaaatctgcgtcattttcgtaacgctgtccagatattccaccgccacagttgccgttacggtatcgccgttcttattcagcaccgtgcttttaagctggctgaacgtatagtccgcgcactttaccggcggcatggaatccccgctgacgtagtaagacagctctttttccgtagccgtcggatacagcgtgaaaaaggtaatcaggaaatccgtaatatcctcgctttccgccgcagaaaccgttccgtcggattctgcggcttttggcgtatatgcagattttgcaggctttccggtgatcgtcggtgcttgcgtgataaccatatcgccgttatcgtccttgtggaccatcgttttgtaaacgctggatacagtgtcttttttcttgccgtccgaaatcatctgcgccactgtgaacacgactgcaaaatcgttttcactgccattctgctccacagaccaaatctgaatgtcctgcacagaagaagaaactgcaacgtcgcttctcacggtatcggccgttaaacgctgcaagtcctcggtgagatagccggtcagtgcatcggtacgctgtgccacagaatccttgttattactccatgaatagtacgttttcgcaaagttccatacaaacgcttctacgccgctggtatcctccacacggcgctcaacaatctccttttcgtgaacggtatgtgtatcaatcgcagtaaagttcttatacactgcaaacacaaatccgcagatgaacagcagccacagcacaattaccgcaggcttgcggctgttcaccgtgtaaacgcgcagttcctttggtttctgctgcttttctttctttttctgaaacataattcgttctcctttgtcttatttctgtgcaaccacagcgccgccccagccccaaccgccgaaaccatagtaggccgtccatccctctacggtatcaatgacagtgccgccgatgttggaaataatctggcccttgccaatgtaaatgccgacatgacccgcatttcgtccgcaggtgtcgttcgttcgggactggtataccgccgggtcattgtaaaccatcgcaccgagcggaatattcttgctggactttccgaccgtatacagcgcacgatttttgcccgcacaacaatgccggtcgatggatacacccgcttttcggtaaacttcttccgcccatgcttcgcaatatccgccagcagccgaaataccgtacttttctgaatttcgtgccacctcgacaatgcgattctgtgcgtccgttccgagcgcgtcaccgcctgtaagtgtcagatattgctttaccaacttgacatagaacatattgccgtagttataccgccagccgccgttgattggcgtggaaatctcgtttttataggtgacttttacgccgccggagtgctgacgagaaaactcctgtgccagctcaaaagtgtatcgcttgccgtttttcgcaacgaagtccaggaagccactgccgtaattgtaggcttgaatgatggcgtctatatcacagccaagtttgtccgcctttgcgaccagttcagtaaaatacttgcagccctgtttgatactgtcctctgtgccgagcgtattcaccggcaatccggccgattccgaggactgcataacgtcctccagcttgccttcgctttccacctgaatgatggcaagcaggacataaacataatcgctgataccgttttgccgcgcatatttctctaccataggttggtgcgcgagcacttccggcgagagatttacgccgatgtacaaacccgaaccacttccgccgctatcctcatccgaagcgataatcaggaacatcgacagaagtaaagcaatcagcagtccgaagcccagggcacctgccattgccgcttttttcatcacttgcgctcacctcggctctctgaatgccgctgtttgcgcgtgatttttctgtttttccgctgtttgaactccgcaccgaaggtttcttcgtccaatcctttaggcattgtgtgtcgtgttttggacttgtccggcattatcggacgttctgccggacggtccggcttgcggtctgcaaccgtagtctgcggcttatccttgaccgttgggcgatcttcccgctgtttttgggtaggctcaatccgttccggccgtggccggttctgcggtacagatgttttttctggctcatgttgttctggtctggacggtttcgtcgttgttggacgttccggtcgttctgttttcggtgcagccgatgtgcttgtctgcttttccggttcagttttctgctgtttggtgacagtcggacgctcccgctgtacaggattgctgttctctgttctggctttctccgaatttccctcactgcgttccattttccgttgagatagctgttcacggcggcttgccgtggtagtcctacgagattccatttgtgcggcacgcgcttctcgacgtttctgcatagtttctcgaacactttcccgtgcagattcaatattgctgtgaaccgcatattccgcattggttggcatatccttaaccttttgcacggtttccgccgctttatcccgcacacgggacggcgtatccgcaatcttgcctaccttttcgcctactctctgaccgagattcttcttctccgactgaacggtttcacggcttgtagaagttgaagctgttctctgtgtgctctgcacggcacggcgctgtgcagaacgctttcccactccgactcctgccgcaaacggcagtgccttgcgaaccgccctcgaaatcgtccggcgcggccggtttgtcatggctcgaccgacacgccccgtgccctcatcacgcagaccaatcatgccgagcagtttgtcgcgctccatatacacgcccgcgaacacgatcacctgcagcagcacgaccaccacaaacggttttccgttcgcaatcgtgtacgccagcgaggacagcaccagcacaaacgtggttagcagtgttgttcccactctcagcatgattgtgttaaatagtgagatgactgctcgtctgctcgtgccggagaacgccggaatcatgctgattagcaagctaatcggcaggaacattgcactgatgatgaacaaaatctgtgacaaaagcatactgcctgtgagcataatcgcaaacaccgacacaatcaggttgaaaatcaggaagaacacggataggccgaaccggcttgtcacctcggttacggtcagattgccgttatcgtaatcttccagttccgacttcacggcttcttctcggtctttgccgcggttttcgtccggagaagtgccgagcaggctgtttacccgttcttctccgatattctccacatccgaatcgccaaactgcatgataagccacggctgttgaacttggataccgaacaggcaatcccgaatcgcagaaacgcccgtgttctcgcctgccgtgtccggtgcaaggattttcgcgctcacatcgacaataccgttgctgatgtcgctcgaaaactcgttgacaccggtaattgcaggtggtgcgtaggcaatcagtccaactgacaccacgaacacgactacaaagttcagcgccgcatgaaacgcctttgtggtttctcgtttgattaaaccaacataggtgcagtacacgccaaccagcagtgtgacaatcgccatcatgccgggaaacagacccgtgctgtccaatccgctggccgacacgcccgcaatcaactgaatgtttttaccaatctcacttgcagcactgctgatgaagtccaaatcgtatgcctgttgaatcaggtatcccacggcatttgaaatgtacaaattcagcgtccacaagaagttcgtaaacaggtaaattgcatactgcgccgttttcccgataccatccagccagttccacggcagccaatcccacgaagaatcaacataaaaatcaagctggtagttatcaatcggatacttgctgaactcgtgcgccgtatcgatggtttcctccaacagtccggcggcgtgcgcctgcacagtgaacaaattgagaaaaaggaaagccatcacaaccgcgataaaggctgtaatggcaattttctgaacttttaaggcatttgtcacacgttacacctcgtttcctgtaaccggcgggcgcgtatcgaacgcatagaacaggtaatcgaacataacatggaacttaatcacgccgacacgaccgtacaggtcttggaaaaggcactgaccgttttccagattgcgaagccgcttctgattgttttcgtcctcggaatccagaccaaaaaattcaagcgttttcttgatctcgttaatatccgtagagcggaacgcaaacttcatgccgatattgttcttgatattctcatccgctacatcaccggcgttctgggtgacaaagtaaacggcagcgttcatcgaacgaccggcacgaaccagcttgtttgccagcgttttgccctgtgccacattgaggaacgcccatgcttcatcaagtccaaccatcttgaagatactgcggtctgaatgaatgaagtccagcgcaaaggtggaaatgacgataagcatggagatcgacagcatttcgatggtggtatagtccgcaggcgcagtgtccttgtccggcagaacaagatcggcaacctgaatgatattcagctgcttttcaaggctgatggtctgttgcaccttgccatttgagaacagcaggtgcgcgaaatcatagtccgtgaacgattcgatatgatctgcaatcgcaagcgcggtttccgagccatcatcccgcagcgcatcaatgacacggagcaatccgcgcatttcgctgttggtcacggcacgaaccgcacggcgcaggacaggaaacagcttaccatcacgcgaggaaatgccggtaaggaaagtgagtacatccagcgcaaggctttctgcgtccttggttttccgcatgatgatatacgggtcaagcatacccttattttcctcgtccgaggtcagatttacaatgttgatctcgtcctcgatctccggcagcttctctttccaaagcccgcgttcagatttcgggtcaaggataagagcctgtgcgccgttcagaacagcgtagtaagtaagcaggttgaacgacaacgatttaccgccgcccagagagccgaggaacgcgccggacagcgcattggtaacagaacccttaacgccctgtgccgctcttgcaggctgcacatacacattctggtctgtatcgacattgtagccaagatagataccgtcacgctcaccgagcatttgcgttgcaccgaagcccagaccggcgagaaaatcactggtgacatactgcacatagtcattcatgtaccgcttacttgccggaataaattcgctgtgcagtcccatcatatcaccgatcggccgaaccagcttgatacttgcgtcatcgtagaaatcgcgcacttggttacagcggcgtttgagttcttccacgtccggcgcggtaacgcgcaccacataggacagcttgtacatggattctttgctctggtcaagaacactttcgagttcatctacgctgtccagtgcttctgccacctgattggtagtttccgagttgttttcccacgcatggttatcgaggtctttcagttcctttttcttgttgcgaaccgtgtgcaaagcagctttgtttgtgataatctcaacattcatgctggtatcaatggaaaaatcaaactgctgttcctgatagtagaaaatctcactggatgggaaatccagttcaccgaccacatccgaaatcgtaaagtacgcaacgtagctttccgaatcctcggacttcatgtgtaaataccgctgtttttcctcaatcagacaacgggcaggcttgataagatcgtactttttaaccagtgtatcacgcttgcgttttttaagtggcagcgtaaacgcaaaatcttcataggccgtgccggtcctgccgtagatatgctccagcagatagccgaagtcattcttatttagccgacgcaccttgaagcggcgggacagcttgttttccatcagcttttccatgcgggaatagcggcggatttcatcgttcggcatactcacgaaatcacccatgaaagaactgctgatagcgttcatcgcatcggatagcacgtttttcacctgttttcctacatctttcacggacaattccttatccgtcacgaccagcttaaagccgagaaagaaacggtaatcgacctgtgtatcaccgagagaagcaacgagattttccgtctgctcgtcaatctcggcgcaagcgatctctttcagccgtccggtcacgcttttcttggaacgctcctgtgcggcgcggatactgctttctgtgctaatctgcaaagcgtgaatcttgccatcacggttctgcgcgatcaactgccggaaagcatcatgcaccgcgtctttctgttccagcgacaggaacgaataattgaacggaatcagttcgtaataggcaaaacactcgccctcaatgttccaaacaaggttattttcaatatatttaatcggatacggcacggataatctcactcctcactacggtaatatccgcgttctcgcggtgctttttcagccggacaggctttccagtaaaggtgactttcgagcgcagcgcataggcaatcaccgagcgcatgaaactgtacggtttcttgccgtcaaaggtctttttgctcataaaccacgtcacgccgaacggaatacagcacaaaatcagcgggttatgaataaacgccaacggcggtactttacggaacacgaataccagcacgccgcttgccgccagccagagcagctgggtcacggtgacaggtgtcggcagttttgcgtcaccgaacgagtatattacctgttctactttccatacactgctgtaacttcttagttttttcaaattgcagctcctttttgtttttctacattacataaagagtatagggggagaggaacgagttccagccgcaggcgtctttcctctccccctgcacggttgatgtataactccctgtcggcagttacacacagccgtgcttcaccccctcaccattctcgcagcggccctccttttagagaacaggattctggttcgttacgaaatgttcatacagattgcgtacatttccgtactccatgagcagcgtttcaatatttttctgcacactttccggcaattcatcgaccatctgacacaggcagttcagttcttcgatcatcatatcttcgtcaatctcgaacggcagttcatagtcacggataacgtagtccggctcctgatcggtcacgccaatacgttcttccagctcgtcatagtcgatgggcggcgtgaaccacacaccgggctgctccatttcgcgggttttatcccgcttttcgatgtaaactcgcatttctatcatcattttcacctcaccagttcaaatacgccgtctttggtttccacaaaatcgccctccatcgagaggtcgcgcccgtactgcacactgtcaaaataccgtcgcagggtttcatctgagatcagcccttcgtccagcatctgctccgccacatcggctgttgtgtcacaaccactccacaggataatatcgtccgcgtgctcgcagaaatcctccacaccgctgtaataactgagcagcgaacccatgttatcccgaatgtagtccggcaggtcctccaccatttcacacaagcggttgatctcctcgatgggtgtatactccccgatctcgaacggtaattcaaaatcgtggatggcatattcctcgtattgatcgttcagaccgatacgctctctcacttcgtccatgtcgataggcggttcaaaccacgccccaatgagttcgccctcattgtatttgccgagatttgcaatgtaaacgcgcatttcttccatgttttcacctccatctcataagaaaagactgacttttcagccagccttacgcaccgagaatctgattgaacagactcagcagaacatccttcacgcctgccgcgttgaacaccagaccaaccgacagcatggccaccacgagaaagccaatcagttttgtaaactcgcgcttaaagccgaggtacaggccaatcaccacgatagcaaccagcaccagcggctgggcgttcgacaacagccagttatacagatttacgccaaaattcattagttatcctccatctgaatcatttcattaaccgttctcatcttctgctgaatgattttgcggtgcttgtcccgcagttccgtgttgtccagaatatcctttacatgggacgtcccgcacttttcatcaatcagcataagcattttcgccgtcggcgcaacctgatgagaaaaccagtttagtgttcgttccagcgtgtatggttcgggttcagtcgtcagtttgagcgtgttccggtgcttgccgataaaggtttcccacatcgggttcagcggccattcctcacgcgatttgccgctctccttatccacaaaacgcacatagcgattgataatgccgaacgccgtctgttccgggttctcgttcgacacaagatcatacacggcgttgtccgcccgctcatttttcaatcggatttcaaagcggttctgaatgtccgcctgttcgagcggcgtaccgtttttcaccagttgctcataggctttctcataaaggcaaaagtataagtcggactgcatcgagccgatgtacagcgttgcacccatgtgggcgctgtcctgctcctgccgactgaccaatccacccgagcgaaacgcccgaaaactgcggaacaccgaaacgcattcctccttacggcatttgctgatgagcagcggaatatccagcatccccaccaggtcattcaccgcgaggtctacccgtttgaacaccgccctttctttcatgcacttgcggaaaaattcgtaccaagtccgcttttgtccgtccagatacgcttcaaactgccgacagcctttgccgcgcagttcgagcagcacgcccatttcttccaacggtgaggtcagcaccatcacgtcaccaatccggtaagtgctcgtgtagccgtacattccacgcggctcctgcaccagatatttcattttcagtcgaagtacatcttcaatgacgtgctttacatccattgttggaaagcggatacgcacatagtcgaacagtagtgtcagcggctcaggatgcagacgaatgagcgcgtctttcagccgcttgcgtaccttttgcggcacggattggttttcctgctccaaccggcggtaatattccggtgtcagtccggcttccagagccagttcctgttcggatatgccaatttgcatccgttttacccgaaagtccgttatccaagtcttattttgcaattttacctccgtttctgattgattttgtacaaagttttgcgtagttcgcctatcttgtccgatttgtacccccctgttagagaaagggggttccgacgttcgggcgcggctgacgccgcgcccgctgcaccgttccgtgccgtcggctttcgcgctgcacgccgccgcacggacggcgcgagggcatagaaaaacgcgcagagttctttcctctgcgcgttttgcgtgtacatatttaatttcaaaaaagcagcgccatataatcctgacgcccatcaagtacacgggtaacttctacatattcgttgcccacaacacgatagaacacaatctgctttgctactactaaaaaccgaatgtccgtatctaccgcatagcgactgcacaattctgtgcccataaacggattatcctctaacagcataatcgcgtcatacacccgacgagttaattttgctgctgctgacggattgttaagctgctccctaatatatcgttccgttgcccgcatatcttcaacagcagttttcttaaatttaattctcattcagcaatacccaacatagcccgggcctgctcggcagaatagctttcggtgcaatcatcgccctttttcagttctttcaccaaccgtgccagagcctttgccttaacaatttccgcattatctcctgtcactgcaaaggggaaaccgcctgcatttaatgactgctgaaaaaacacattgattgcgtccgtgagtgtcaaccccgtttttgcataaatctgctccaattcttcacgaatttcaggattcatgcgaatacggaacatatctgtttttgcagaagaaataacattatccatcttgcagacctccttttcaaatttagtataacacatcgtattctatgcgtcaattatgtagctacattgttgctacataattattttgcacacctcccaatctcctgcaaaaagtcgtaccctttcggcacgatcggagtataaaactccgtaatcaccccctttccggtatcggcataacctctgcccttgatattcttgaaaaagaactcctttttcgtttcgccaaacatcatactgtatccaagttcggacattctgccaagcgcgacacggaaattaaactggtcgcggataccgtcaccgaggtatttagcatccgggcgctgacaagcaagaatcaagaagaatcccgcctgccgtcccagcataacgatctgccgcagcttattcaacacatcttcgcgctccctgcttatcagcatttccatgaacgcaacgtactcgtcaaacacgagaaaatgcggtgaaagtccgagatatgcatagttttcgccggttttgtaattttccatgcgcttcatatccgcactgcgttcgtgcatagccgtgcagaaatcggtaatactctgcacgattttctctttgctgctgtatacattcggcaggacactggataagtccgctaaatctgcgtttttcgggtcaagaatgtacaaaaccgcattagtttctaacaatgcccgaatcaacgtcaggataaagtacgttttgccgccgcctgtaccgcccgcgatcagcatatgcggcagactgtcaaactcccaataagtgttctgcatgagccgcattttgccgtgctccacgcgaacctcggagatggggatacggtttgcgatcatgtcatacagcagcgtgtactccacaaacccatcaagtaattctctgctgaccagctcacaatacaaaccgctttccagcttgttttccaagtgcagcagcggttcttgaaactttccgagcgtaatctccgccgtgatatgcaaaagcccgttttccatgcggtaatacaatcgcggaaaacgggcaatcttcggttttgaacttgcgggcaggtccttaaaaaatccctctgcctgtttagtgtcgctctgctcataccactggttttccagcaccatgcgcgccagcttttgccgatggcgcatttcattcagcttgtccagaaaccggcggtacagcagccacgccgtcacggtacacacttttacacccatggccgcgctgaacagcagatagggcacggatggattgcgccagtccgtgcggatattcagcaatacaaatgtcacagcaaacaccgcgaacagcaggaaaaacaccgttcggaacaccaaatctttatcgctcgggcgaatccgcctgccgcgatttctccacagcctgtgcattacgatttcttatctgccggaacatccttgtgcggctggctgttctgcgcgggcgttttgagcaccagatcgtccgccttgatgtaccagtccacctcggcgctgttgccgaacgtcacatgggcgattgcaccgaacatcgggttgaccagcttcacttccgcgttgtacgcaaaatcgcgcaccggaacgctcgccggaacactgacctgaatcatacggccctgcttgtcgcttttcagatcataggtgcgctccttgaccacctcggacggcgtgccgtctgcgttctcctcaaacacctcgcggcgcattgccgaaaaacgcagtgtgccgagtgttgcttcattttcaccgaaaaaaccattgctgaatctcataaatcgtaccgtcctttcttgtttacgccttttccatatcttccgcgtgcagaatgtagtccacaaacgcgcggccgttgatcacatagccctcagccgtcaccgacgggttcttgagcttgaccggctccatgtacgcaaactgcttctggccagccgcgccgtcgatcacaacctcaatatcatccgcacgctgcacatcgctgaacagcttgtaccggcggtacagcaccttggtctgggtgccgttgcggcgggtgtcgccgcgctttacctcggccgggccgccaaattccagattgccgagcgacttcgccatgttcgggataacaaatttcagttccataaaattacctccaaattctaattcattacttccgcgatacccgccatcacatattctgcgcacggcagggcaatcgagttgccgagtgcgcgataacgggcatgatcgctgatttcttcattcttgcagccgtactttgtccagttttcaggcagacccatcaaccgctcacattccagcggtgtcagcgcgcgcaggaatccgtcttgttcctcaccctcgtaccaaaacgaaaacggcgccgttacactcgcaagcagagttgggaatggttctcctccccgtccgaagctggcgcagaaccctttctgatctccgacctgtgccatggttcgcatccgccggagggaaaacggtctgacgacgggtacctgccgccctgtttgagcagcaggcactccacttccggcggtggcggacagcccgcccgaaccgccaagcgcagaaagcgtgagcacagtccggggcttaaataatacttctccggcacgctggcctgcaaaatccgccacgacgaacacacgcttgcgccgctgtgcgagggcgggttctccccaatactgggcgtccagcagtcgccaagcggtatcagcgcgtccccctcgcaccattccggcgtgcgcccatccacgaggaggcactgaaacctcggcacctgtgaacgcactgagcatggctgcaaaatccagcctgtcatttgaagaaaacgctcctgcaacgttttcccaaatacagaaagctggataccgaccattggttgcatatctcatctcctcgataattcgcatcgcctgataaaacaggctggattttttgcctgcgaaaccatttctcgtgccaatctgcgacaagtcctgacagggcgaaccgaatgtaatcacatcgaccggcggtacctccgcaccgttaattttcgtaatgtcgcccaagtgcagcatatccgggaaatgccgtttggtgatggagatcgggcgtgcttcgatctcgctcgcccacacaggttccatgccgcagtgtaccgccgccaatgaaaacacgccgattccatcaaacagactgccgagtttaagtacggtcacgcgcgtacctcgtgcggcccatcgtgccgcggatacggcagttgccggtacggattttcttgccgcgcacccgggcaaggcagtcacaatgctcgtccgggtccaagtgtgcgccgcagtgcggacaggtgttgtagtacatgagtatccctcctgctattacatgaattgtcatactatctgtacgctgaacggcggcggtctggcaaacaaacaatagattttatattgagtaagcatgatcttttcctttttcgggtaatgaaaaagccgtccttctttgagaacggctttcgctttaccagtttttggcgtaatatggtttgtattttaggaaacagcttgtcctgcgttatgtttgtcattttacggaaattttgttgttcttgtcacatcgcagcccgaaacagcttgtacaaatctcccctaaaagttgttcttatcccatcgtaccagagcaaaaagccagaacaacctacgacaaccttctccgcctgatcgacgacccggatgttcgcgaaccgctcaaattcctgcgagaacgagaagtcgtgcatttccagcggttcggagacgcgctgcgcgttgtgcaggataatctggatgccaagaactactatgcctacaacccgtccatcgacatccggcccaaagagaaataacgcatttgcaaggagatggtccctgaccgtctcctttttttgtgcaaatactgcatcaatccggggcactgtgcaaaacaaatttgaacactttactgtgtaaagtgtcttttcttttccgtgcatttctgctataatgctattaagtagcgcatattatatatttgcctgatcactatcggacaggccttcgcataaatttcagtaagtaggggaacaagcatgaaagaacagaaattggtcatcaccggtatgggcgctgttacgccgatcggtattggtgtggacgcatactggtccgcactggtggagggacaatgcggtgtaggaaaaattacccgctttgatgcatccgaactgcctgtgcagatcgcggcagagctgaaggacttcgatcccgctgcctacatgccgaaaacgctggcccgcacgatggacccgttcatgcagtttgcctttgttgcggccgaggaggctctcaagaacagtgagctgtccatcgagagcgaaagcgaccgtatcggcatcgtcatgggcactgcaatggacggtgttaccaccgttgcacagacgcaggctgcgttcgacacaggcaagcgcgtcggccctcgctttgtgccgatgaccatcggcaatatcgctgccgcccagatctcgattgctcacggcattcacggcccgagtctgacactcaatacggcatgctcggcaggcggcgacgctatcatgaccgcagcgatgctgctccgctccggcgaggcagacgcggttctggcagtcggcggcgaaagcattctgtgcccgatcgtggtttccggtctgtcgcaggccaaggcgctttcccgccgaaacgacgaccccgagcaggcgtgccgcccgttcgaccttgaccgcgacggcttcgttatcggcgaaggcggcggcgctctcctgatcgagaccgaggagcatgcactcgcccgcggcgcaaaaatccacgccgtactcgccggttacgcgaatacctcagatgcacaccacgttaccgcgccctgcccggacggcgaaggcgcttcccgctgcatgaagctggcgctcaagagggccggcatgcagccgtccgacattggctatatcaacgcgcacggcacgtccacgccgctcggcgacaaggccgaaacgctggcggtcaaggccgtgttcggcggccgcgaaagcgcaccgccgatgagctccaccaagtccgcgaccggccatctcatgggcgccggcggcctgaccgaagccatcgcctgcatcaaggccatcgaggaaggcgttcttccgcctaccctgcacctggcaaagcccgatccggaatgcgatctggattatgtgccgaataccgcgcgcaaggcggaaatcaacgctgcaatgagcaattcgctcggcttcggcggacagaattctagcctgattgttgccaaatacgagaaataattcccatcaagaatacgcagttagtgattatgtatccttaaaattgcgaatctttatcctattgcaaataaaaataacagggacatcggcatgtagcctgtgtccctgtaagatttttcttcttgcaatttcgtgattgtatggtattataatattcgttaagtagtttttaactctacatacagccatcccctgaggtaattatgaattgctaattccccatacaaattattaagaggtgatcccttgagtcacgaatatacctatgatatttccatgttccgcgacacatttgaaacccgtttcacctatctgaacggttttctgcgcaatgtttcgcgtttcggcagccgaccggcactctttgacccgcattccggccgccgctggacctaccgcgaactgaacgccgaagccaaccgtctggcgcatgcgctgcgcgcagacggtgtcggcaagaacgatgttgtcatgttcaccctgctcaattcgccggagtttgttttctgctatctggcggcgcacaagattggtgcggtcgcgtgtccggtcaactaccggcagggcgcaggcgagattgcactcgtcattgatgacagcacgcccaaggctttcatctacgacgccgagttcggcgagctgtccggcggtgcgctcgacctgtgcgagagcaagcctgccatcaagatcgttgtcggtgcggacgatgccgtacctgccggtcaggtgcgctatgcggattacgttgccgatcagccggagaacgacccgccgatcgacttcgacccgcacatctacgacgagaccacccgtctgtacacttccggcacaaccaaccgtccgaagggcgtgccgatcaacaatatcaacgaggtgctttccgcgcatgacgttatgatgcacttccctctcggtccgaccgaccgcacgatgaacatgaccccgtggttccaccgcggcggcatccactccggcggcccgtgcccgaccctctatgcgggcggcgaagttgtcattctgcgcgattttgcaccgaagcgctgccttgaatatgccgcgaagtacaacatctcgttcctgatcggtgtaccgaccatcattgccatgctcgcccgcacgcaggagcgcaccccgcacgacctgtccgcgctgcgcggcattgtcaccatgggcgcgccgtttgaaaagagcgcatgcgagaagtacatgaagctgctcacgccgaacattttcaacggctacggcacgacggaatccttctggaacacatttctgcgcccgttcgacctgccggataacgcaggctcggccggccgctcgtgtacggatgacgaggtccgcatcgtaaagctgcgtgaggacggctcccattccgagccggacgacctggtcccgcacgacaacgtggccgagggcgagatcatcatctcctctccggcaaagagcgcattttgttactataataacccggaaatgaccgaacagaagttctacaagggctttctgtataccggcgacgtcggcacatgggacgagaacgagttcgtcaccgtacgcggccgcaaggacgatatgatcgtttccgcaggcgagaacatctatccgccgcagatcgaggccgtgctgaacgaccatcccaaggtcgcagagagcgccgttatcggtgcgccggacaagctgcgcggcgaagttgttgcggcatatgttgtaccgagcgatccctccctcaccgttgaggagctgaaggagtactgcacgaacagtcccatgctgtcctcgtacaagtggccgcgcatctacaacatcgtcgattccctgccgcacaccgcgaccggcaaaatcatgcaccgcgccctgcgcaacaaggcttgacagccgttccctattgttaaaatacggagggcaagtcattcatcagaaatgacaagccggataaggtgacaggttgagatacctgttccttatccggcttttttgtatgtatggagaatggaaaatgacacgaacttatgtcacccgttctccattttactttacaaaatcaaagaagggcagccaccggccgcccctgcagaatgtcatcctatacaataattactaactgctgatcttacaaaagtccctgcagtgaataaactgccgccagcgccagcagaatggcgatcagcgttttcagcacgcgcaggaatcgctctcttgtaacaaaccgccgccagcctgtcggcttcgggtccggaggaagcatttcgtccggtgtcggcttatggtcgagcagcctcacgtcgcaatccttgcatttacgaacattctcgacgtattccgcgccgcattttgggcaccaaggcataattcgttactccttccagatgaaaatcggcagcggcggatcatttttgcggttcatccactcacagccgagcacggtataggttcggtcgtcgagttcctgcaagtgagccagaatcgcgtcgcgctcctcatagccgttttccttgccgtaatagagcgcaagcgccatcaatccgccttttttgagcagcttcagtcccgcatcaacagcaggcagtgaagtctctgcggtggtgaattttgtcgggtctccgccgggcagacggccgaaattgaacacgatgcagtccacggtctccggttcggcgtagtgcgccatgttagcgtggctgtcgaggtaaacctcggcgctgagatgctctttcgccagcagctcgcgggtctgccggacggcatccttctgcacatcaaaggccagcacgcggccgttttcgcctgtcagacggcacagcagcgctgtgtctctgcccttgcccgcggtcgcatcaatacaaaaatcgccttcccgaacctgccgccggagcacatcatgcacaaccgaaagtgtgttcatgctctgccctcctcaaaagcggctgccgccgagagcgcgcgcgatttcgtcccgcgcagccatgagcggcgcacgcagctctgccacgcgctggtcggtcatgcggctgaccggcgcagacagcgaaatcgcgtaggacgcgcgtccgcggtagtccggaatggcggccgcaatgcagcgcacgccaagctcgttctcctcattgtcgagcgcgtaaccaagctgacgcaccttgtcgatctcacggaaaaacgcgccctcatcgacgatggtgtgctcggtccacgcatgcacatcgctgtgctgccacacgtcgcgcacctctgcggtgtcccatgtggcaagaattgccttcccgacgcccgtacagtacagcggcaggcgcatgccgatgcgcgagaacatgcggatggcagacgagccgttatccactttatggatgtacacaatgtccttgtcgtcgcgcatgacaaggtgaacggtctcatccgtgcactgctcgagccgttcaagcgacgcgcgtgctctctcaacaatatccagattatccacaatatagctgctcatctcgcacaggcgcataccggcgcggtagacgctggtttccgcgtcgcgctgcacatagccacgcgcacacatgctggccagcagacggtgaaccgtgcttttgtgcaggccggtttccgcagacaggccgccgatgctcatgccgttgcggctgcggcacagagtttccagcaaatcgaatgcgcggtcgagcgattgaacggtcgattgctccgccatgaaaacgcttcccttcgttccgtattataaaacacatctctattatacagcaaagctgcacaaaaaacaagggattattttggtgtggtcgccaaatggggtcggtcgcttgcgaagcgaacggaatcttgcctgcccggcgagggcacaagaaggaggacaccgaggtttcctccttcttgtgaatcatccactttcctaagagggcacggcgaaatttgcagagctgagactataggggaacggcagtcgggttactctaccgttcatttcgtgaaatattcgcagttcacagatagattactgctacacaggtggtttactctccgcagagcgcggcataacagtgccgcgcaacccgttggcacgttgtaacagacagcacctatgaataaatctgctgataaacgctatcttgcagggagcgaaatttctctttttacaaagcaaaaccacagtcaaaacgactgtggtctgcgtaaaatgtttgaatcagacgttgaaacggaacagaacaacatcgccgtcctgcatcacatactccttgccctcggagcgaaccagacccttttcgcgggcagcagccagcgagccaagctcgatgaggtccttatagttgataacctcagcgcgaatgaagccgcgctcgaagtcggtgtgaatcttgccggcagcctgcggcgcctttgtgcccttctcgatggtccacgcgcggacctcctgctcgccggcggtaaggtagctcatcaggccgagcaggtcgtagcagaccttgatcagacgatccagaccggactcgtgcaggccgagttcggacaggaacatctccttctcctctgcgtccatgccggcgatatcttcctccagctttgcgcagatcggcagaaccatcgcgccttctgcgtctgcaatggcctgtaccgccttgaggcgctcgttctcggcatcgttgccggtaaagccttcctcgtccatgtttgctgcgtagatgaccttcttcgcggacagcaggtcgctctcaccgatgacgcggtcaatgtcctcgtcctcgccaaagccctcgaaggtgcgggcggtcttgccctcctccagatgcgccttcaggctctcgaggatctccacgtcacggagcagcttcttgtctgccttcgcagccttgcgggtgcggtcgagacggcgctcgaggtgctcgatgtccgcaaggatcagctcgaggttgatggtctcgatgtcacgggccggatcgaccgagccttcaacatgcacgatgttctcgttgtcgaagcagcggacaacgtgaacgatggcgtcaacctcgcggatgtgggacaggaacttgttgcccagaccctcgcccttgcttgcgccgcgcaccagaccggcgatgtccacgaactcgaccaccgcaggcgtggtcttctttgcgtgatagagatcggtcagcggctgcaggcgctcatccggtacagcgaccatgccgacgttcgggtcgatggtgcagaacggatagtttgcgctttccgcgcccgcctgcgtaattgcgttgaacaaggtagacttgccgacgtttggcagtccgacgatgccgagtttcataatataattcctccaactttataaggggattttctgctccccgttttctgcataaaaatagtataccgctttcgctggaattttgcaatgttttgcgctatactaaagataccaatttgtctgcaagaggtgaaaagccatgccttcttatgtcacttaccatatttttgcggctaccgtacagcgcgtaaccagtgattcggtcgcccatatcgcgtcctcctacccggcagcctaccgatggggctcgcagggaccggacccgctggcgctctatcacgcgccgttcccgtccgcgctgcgcagactggcgaagcgcgtctgcaccgagccgcccgcgccgctgtttgagtcactgtgcaaagccgccgttgcgtcgcacaacacggctgcactcgcgtatgtatttggattctgcacgcactatgcgctcagccgcgtaacctattcgtttgtttccgcacaggcggacaggctgtcgcagttcatgccgggctactccgccgaggcacgccgccatttagtcgagagcgacatcgacggtgtgatgatcgcggattttgtctcggacacgcccgccgagtatgaggcgtaccgtcagctggagccggatgcgcccgagtcccctctcgcggcgaaaattctggcgcaggccctgcgggagacgtatggcgtgcacatcacgcctgccgccgtctaccactcgatgaacgatatgcgccgcatgcaccatctcgcgcatcagggcgcctctgcgctcacccgtctgcagcggttcgagcacctgatcggcaaatccggttttgcgtcctcgctcatccgtccgacagagccgctcgcggcggactgcaccaatcaggagcaccgtccgtggacatcccgcaccggcgagcgaacagattccttctccgatctgtttgattccgccgtgccgctggcagtctcgctgcagcgtgccgctctcgaccgttattatcagcagaagccgctcgatccgcgctttttccccaaggattttacgggcacacccatcaaaaagtaaaaatttaagaacttagcgacaggtttcgtatgacttcgctccctgaaatgggtattcttggttttgttaccaaactgtaaccatcgaaaggagtgaatatggcgcacatcattccgccatactactatcatgcgaaacctgttatcttttgttttgggcgtgatttcacgcctgctctacctgcttctgcggctcatcctgctgctcgaccgcacgatctgccgcatatacgacctgccggtctggagccggttcgccggtgttctgcggcaggcaggccgccgccgttcggtctgtgcgctgagcgtattcgggctgctgttcctgctgcccgctctgctgctgaccaggccgggcacgctgctgcttgcggacggtcagccgctcggtgttatcgaggacagcgcaacgctgctgaacgcagtaaacgcggttgaatccagcgcatccgctgtttccggcacggactattatctgccgctgcgcctgcaggccagaccggtgcggacagccgctcccctgctgacgcaggaggaactcgagcacaatctcattaccgccagcggcgagctggacacgcttgccgtcatttcggtggacggcaaacagaccgccattgccgccgacacggacggcgcacaggccgcgcttgaccggatcaaggccgcgtatacgacagcggcagacgaaaacgtacacttcctgcagaccgtccgcgtggacaaggccgttgcgccagccgcgcttgcagagaccgatttcgcgctgtatgataccctgtcgcagtgccttgacgtgaccgcgacccgcgccgtcacctacaccgagcagattccgttcgacaccgtgacgcagaagaacgaaaatcaggaccagacctaccgtgaaaccgttcagcagggctgtgcgggtaccgcgcaggttaccgccgagattgaaaccgtggacggtgaggagcgcacacgcaccatccttgcgcgcaccgtgctccggcaggccaccgacgaaattgtcgaggtcggcacgcgcaatgtcggcatcggcaccggagaatttgccgtgccgctgaacagctacacgtttacctcggcgttcaagtaccgctggggacgcctgcacggcggcgtggacctcgccgtggacgaaggcacgccggtctatgccgcggataacggcaaggtcatcgtcgcggaggactccggcaacggctacggcagctatatcatcctcgaccaccagaacggcttcaagacgctgtacgggcataactcacagctgctcgtgtcggtcggcgatgtagtcggcaagggagagaagatcgcgctttccggcaataccggcaactccaccggcccgcatctgcattttgaggtgcaggtcaatgatgaaaaagtagatcccactcagtatgtgcagttgagttaaccggtgaagtaatggaaaattgagaatggagaatggaaaatgacgctatccctgcgcgagttccatccgcgccgcgtggaagtacgcgctgcgcgcgttatcaaggcaacaccgcacaattaaaacggcggtgctttgcggaaattatgcggtattgccttaaattatcgcgcacggtgcgataccacaattctcaataaaaaaagagattggcaaaaggcagctcccgataagaaaacatcgtgaggaaagagagaacggtatagcttcgaatagtgcgaatcctgataaccgacgtcaaacgcaatatcgctcatgcggctgtttcccttgatcagcagatgctttgccgcctcgatgcggacagcggtcaaatactcgacaaaggtctgtccggtctcctgcgagaacacggtggaaaaatggttcgggctgaagccgacttcctccgcgccccgatgcagtgagatcgcactgtctgcatagttttcacgaataaactcctttgcacggctgatctccgcgctgtatcgcacattctgcacgtcctgcaccccggacaggtgtacttcacgcccatcgaagcagccctacccgatctcgatcccgccggcatcgcctttcacggcaccgccgacccgtgggcgcgcaccgagctcatcaccgagggctgccgccgtcttggtgtgccgctgcatctaactgaaaacgccgatcattccatggaaaccggcgatgtcctgcggaatatcacaatcctgcacaccattctcgagcagaccgatcgctggatgcggcagcgttgcatctgaccgtgccatctccgacagcagatcccgtaaaattatgtatccgtttgaggaaagcattgcagctcggtgcaaaatgttgtgctcttttcttgtatgaccttacaggagagtttactgtgaaaattttacatatcacaccctcgcaggacgggttttatatgcccgcggaatttgcgccgcatgaagactgcctgatgatctggtctgaacgtgccgatccgtgacagtaaggcgcctatgccgcacgcaaagcctttctgcgcgtgatcgaaaccatttaaagcgaacacatgaccgttctgtgctcggagaggcagtacgacaacgcgcgtgcccagcttcccgacctttgtcatcaacggcaaaggcgaacgccgcggcatcgactggggcttcaacacatggggcggcgaaggggacggcctgtatccctcgtgggagaacgacaaccgcgtggcacgcaagttctgcaacctgctttgcaatgacgtttacgacaagcgtgattttatctgcgagggcagctcgatccacgccgacggcgagaacgacccgcagtatgcgctttccaagccgagaccggacactatgttggccgcctggaagaactggcgttcaaccaaggcggctgacagccgaacaggtgcacaaggacggacaagagctcggaataacgctttatggacagtacttgcagtgcttatgatggagagcattaacgaggagaaaacatccctgtacaagaaaaagaggctcccctatgactgcattcaccgtaaaatactacaccgcagattttctgcatgctttcttctccactgtctgcgggcggctggaaaatgggaaatggggcagccgctttccccatctcatgaacgagctgtatcaaggcgtactgcctgtcaagcatctcgcagctggtacggaagagctgtcacagatcaagcaggagcttgctcaattcgcgccggatcaggtgatctgggatattgacgaccgctcgctcactccgccgtggggcgacaatatcagcgaggatattaccgacctcagcaattactttgtcactagcgagggagaggattttctctcggtattcgccgctgcgctggacaaggcgcagcaacggaacgcatcgctgaaaattcagacaatctgaggcgactattcaggcgaccgggcgactctaagcaacggtatccccgctgtcatacaagccgaaaaaatccgtaaagtccttattttcatatacttttcaccgtaaatccgaacgttagctctcaaagctcaccgctccgactccaaaggccatgcgttcgaatcgcaccgggcgtaccaaaatgtgttgatgaaagatgcaacgcagaaaacgccgcacgagagtgcggcgttttcacatataatgcgccacttttaggatgaaaaagttgcaaaaactcgatttttcaacatttcagtttttccgcgcgagaggcgacatttcagagatgcagcagagcactcttgcggactggtgtgacttgaacaccgaggctaaaaaagaatgaataataagaaggcaggccgccgttcggctccccatgtgggagagaacggcggccttttctgttacattggtgcttatgttgctttcgccttgtttgtctatcattccttggtggtgttggtaatagctttctcgtaacctttcgggtatgcttgcgttacaaaaatacgaaagaggtgtccgagaatggcaaccaccaaaaacttgtgcgctcagatccccattgacctgcacgagcgggtcagcgaagaacgggaacggctgggccagaccaccagcgagtacatcgccaacctcatccaagactattacaacatgatggaaaatcagaaaggcggcattcaaatgactgaaaaaggcagaacgatggcattccagatccccgaagaactcttccagcgcatcaagcgtcatctggagcgcgagacgctccgcaccggcaaaaagctcacccagcgagacttcgtgctgaacctgatcacgcaggcgctggatgaagcggacgctgagaacgccacggagcagaacacccccactgaggcccctgtcgcgccctgtgtagccaacgagaccgtccccacaggcacggacacccccaacgaagataaagccgtgtaagcccacataaaagccaaaacaaaagaacacgatttagggaaaagccactcagggcatccgagatattcggatgccctgagtggctttttgcgtttcaccagaaaggagggcatcacaatgacaagcgagatcaaaagacgcttcacagatacagaaatgcagatcgccagagaaaccgacctgccggagctgctgacccatctgggttatcaggtcaaacgcatcggcaggtactacaccaccgcagaaatggacagcttgcggatcaaggatcgacgcacctggttccgctactctcaaggcatcggcggcgacgcgatcactttcctacagcatttctgcaaccagtcttttccggaggcagtagagtacctgttgacctttcaaggcaaggccagagacgctcctgtcaaaacaaaaccagtcaccaagcaggacgagccgtcaaaagagtttgcattgcctccgcgcaatgccgatgaccgccgcgtattcgcttaccttcgcaaacgcggcatcgccgcacaggtgatccgtcagtttatgaacagcggatcactgtatgaggatgcagtccatcacaactgcgtttttgttggcagagatcacaccggacaagccaaatatgcaggtctgcgcggcacctatgaccgcgacgggaaagggtttcgcggagatgtatccggcagtgacaaagacatcggcttcgctatcccttgcgatcctgtttccgaccaagtccgagtctttgaagcgcctatcgaccttatgagttattacaccctccaccgaagctgctgcaatgcagtcgccttgtgcggtctgtatgatggcgccttgcgaacctatcttcggaacaatctccagatcaagcggatcgttctttgtttggatatggatacaccgggacaagaaacggcggaacagctccgaaaaaaatacgcggaactgggatatgagatatcgcaggagaagccccgcagcgggaaggactggaatgagtacctgcaaaaaaggaaagcgctggaaagggggcgatgacgcgatcgatccacaatagccggaaaaaacaacaaggaggaaaacacgatgagaccgagaaaatttgttcgcagcacggcgctcgtgctcgtgctgacggcagcgctgactgtcactgctttcgcggcagatcccacacagcagccagcaaccaaaaccgacaataagtcttcgtattatcccacttcggtggaaatgaccgaagatgacgccgggaatcccatgatccgaaagacctaccagctgagcgtttcggatgacccgcaaaaactccctgtcgcagactttgagcgcgacggcagacggtattaccttttggacatgacgaaagaggataagatcggcgtagatacgaaagaacacagcgaaacggtcaagctgtccagcgataccaaagagatggagcagatcctccagagactggacgcgcagaaagaggtcaccacagaggatggtcataccggagttctgacactggatcataccagcgtcaaggtaactgcggacgggtatggtacaaagaaacgcaccctctcagcgacgcgcacctatcccaatttgtcggatgccgatgtagctctgatccccaagacgatccaggacaatggccataccctcacgctggcagatgtccggtgggacagcgcttaccaaaccgaagcagacgaagccgtggtgcgctactgtgctaccgcacagtacaccggcgaaagcagcagtcagtatgtgaccggttacacggtcactgcggattactccggcagggtcacaaaaacaagctgtgatactgtcgtttacacagcgatctttgacagtatgcctctggaaggggaacagccggtgaaagaaacagatcaccgcctgcccattgtgcttggcggtgcggcactgctgggagcaatgctcggcggagcagcaacacggatcaaaaagaaaaaaagaaagggggacgaatcgtgaaaatgaaatttcgtagcctgatcgcggctgcggctctctgtactctgtgtgttggacaggccagcgcattggaatacaccgtagatgcgccggaggactatctgttcggcacgcccaccagtgaaggaactgtgtacgagcaggaatcgaacaatgtggatcgcggaaaaaacaccgccttgatcccgcccggtttcggaacggccaccagctatttgccgggcagcggcgagccgttgacgccgaacctgctccccggtgcaatgtccggcggactgattagctcagtcaaaacggatagcagcaaagtaagttatccgacggttgactcgactgcggatcattggactggcgcatcctttacggcggtcacgccaaacctctattacaatgacgatcatcttggaactctgagcattccgtccatcggtctgaatgtcaaggtctaccagggtacggacagtgccgcactgcggaaaggggcgggacacttctcagaaacgagcatatgggacggaaatgtctgccttgcggggcataaccgaggcgttgccaatcatttcggcaagatccatacgctgaaaacaggaaacatcatcacctatacgacgaagctcggcaccagaagctacacggtccgcagcgtttccaaggtgctgtacaccgataccagcggaacctgtgcttctgatgagaactgccttactctgtacacctgcgtcatggatcagccctcgtaccgatggatggtccgagcggcagcacaataaattggaggtgtgaccttgaaaaaacgattgatttccatgttccttgtgttggtgatggcgcttgggatgttccccatctccgcttttgccgccagcagcaccattgccggtgcgctgggtgaggtgaacattaccaatggtgactataaaatgtcttatctcagcatgaacggcgttgtccgttcccagtcctatacctacttcaatttcaagtcggccagcggcgcgttcaaggagattcccgcctactgcatcaaccctacaacaaagggtgtgccgcagtcggtcagtcccggcacgagcatcaaatatattgcaaacgaggccagcaacgacccgaagatcgtcggcatcatcgccaatggctacccccatcgtggcctgtctgagctgaaactggagaataaatatcaggcgtactacgccacgaagatggcgctctggtgctatctcatcgacggctggagcattgaccggctgacggtcaatccgtccctgtccggtgtggagaaggaacgcggcgaaaaactgctggcggcggcaaaggacatctacaaacgcggtatctggtggaaccgtgtgccgcagcctaccatcacggtgacagccgataaagattcggcctatcccgtcaccatagacggcaaggaatacttgcagcaggtgttcacagcggattcggaaacatgggtttgcgactatgacatcgacatcggattcaccatgcccgatgaagtgccggagggcacccgcatcgtagacatgaacaacaacgacatcactaagatcaggacctcgtccaatggtgccagctatgccggtcagttcaaggtgctgtaccccaaggacagcgtaagcgaccagaccggcgcggtgcagatgtcgctccacgctaatgtctacaaatacgccatttactatgctctgtgcgcggagaccagcaagtatggcaccctccagcgctatatgtgcgacaccgatcctacgacggaaatccgccagtctaccttcagccgctattcttccacgccgtctgataccccagacgagccggaaacgcctacggaaaccacgcttatcatcaacaaggtggcgaccggcaccaatacaccgctttccggtgcaactttcgaggtaaaggcaccggatgggacggtcctcggcagctttgtcacggataccagcggcaagatcattattccgctgaccctctccggccagtatgtcattacggagaaagcagcgcccaagtggcacctgctgggcacggaaactaccaagaccgtttccgtggactacggcaataccgcgactgtcacctttgaaaatgcaccctacggcaatctgcgcgtggacaagatcgacgcggacagcggcgcttctctcgccggtgcgactgtggagatcaagcacatcgaaagcggcgtcacccagaccggcaccaccgacctcggcggcagcgtgtacttcgacaagctgaagcctggtgcatatcaggtgcgcgaggtgtctgcccccggcggctatgtcaaggacgaccagacctacaccgtgaatgtgacctccggcacggaaaccagctttgtgctgaaaaatcaggccaaaccgggtcttattatcaccaagtatgatgagcagacccatgaagttctgcccgatgtgacctttgaagttacccgcgatactgtcctcatcggctcgttctccacggacgagatgggacagatccgcctgaccgacctccagccgggaacctatctggtgaaagaggtttccaccagtgcaggctatgtgttggacagcacaccgcagcaaatcgagctgaccgcaggcggcggtatcaaaacgctgactttcttcaacacggtcaagcccggtatccacatcatcaaggtggacagccgcacgatggagccgctaaccaatgtcaagttccgcatttctctggtgggcggcaccttctccaaggaatatgtgaccgacaaaaacggcgagatcgacctgaccgcactggagccgggcgcgtacaccgtggaggagattaccgcgccgaatggctatctgatggatgatgataagcgtatcatccagatcaacgccggagaaaatgctcgtttcgtgttcaccaacacggagaaaccggttctgtctgtggtgaaatatgacgcagagaacgacacctatctcgccggtgcaacctttaggatcgcaaagatcgaggacggcagccactatctcgaccgcgtgactgacaccaacgggcgcatctccatctctgatttggaacccggcgtgtactcggtcaaggagatcgcagcgcccagcggctatgtgctgaacgacacggaataccatgcagagctgttccccggcaaggacagcacgctggtggtgaataacgagaagaagcccaatctcaaaatcgtaaagactgacgctgtgacgggcgcaccgctggccagtgtgaccttcaccgtaaataaggcagacagcagtacgctcaccaccgtcaaaaccgacgccaacggcgaggctctgctcaccgcccttgaccccggtgtgtatgtggtgcgtgaaaccagtgtgccggacggttatctgctggacagcgaaccccagactatcaccctcgttcccaacaaaaccggcacggtgcgtttccgcaattatcccaagcctacgctgaccattgacaaggtggacagcatcacgaaagaccctatcaagggcgcaaagttccacatcacctatgccagcaacaacagcttcaccggagaactgaacgacctcggcacttatttcaccgatgaaaacggtcaggtcaaactcacaaagctgcgcgacggctggtatcgtgtgaccgaagtggaaccggcagcgggctacgccatcaaagacccggccacgcaggactgctttattcaggcaggcaccggcaagacgctgacctttgagaacacgccgctttcggcgcttatcatcaaaaaggtggacgcggacagcggagccatgctgcaaggcgcgaagttccgtgtgcgttatctgggcgggacctctggcaccggcggtacggtcatcggagaatacaccacctcggccaatggtaccatcgtgatcaccggactgaaagccggaacctatatcgtggaggaaaccaaggctcccgcaggctatgagatcgacgacacgccgcagaccgtctatctctccggtaaggagcaggatgtggttacggtggagttttccaacggaaaacacggcgatcttatcatcgacaagatcgacagcgtgaccaagcagccgcttcccggcgcacagttcaaaatcacgacctcagatggttcgtttgtcggaaactacggcggcacggtcacttctaatggcatttacaccacggacagcaacggccagatcaagctggtggacctcaaaccggatacttatgtggtaacggagatcaaagcgccggacggctatgtgctggacagcacctcgcagaccgttaaggtcgaccgcaacgacacgcagacgctgacctttaccaacacgcccatcggcggcggtcagatcatcaaggtggacgcggacagcggcaagcgcatcaagggtgtgcagtttgagatcgccaagatgaatggtgagcgcatcggcacttataccacggacagtaacggcattatcacgctcccgcagcttgcggacggctggtacaccgccaccgagattaaagccgcaaaggggtatctgctggacagtacgccccacaatttcgaggtaaaggctggtaggacgacctcgctgaccgtcgagaacacacaggccagctccatgctcatccacaagatcgatagtgtgaccggcaagggcatttacggcgtgaccttcctcgtttcggacagcaagggcaaccccatcggtcagtacacctccgaccagaacggctatgtctatatcgacaagacgctgacggacggaaagtacctggtgcgggaaatccaggcggcggacggttatgtgctggataccacagtcaaaaccttctatgtggaatacggcggcacttctacgatcacatggaagaacacgcccatcacaggccagatccagatcgtgaaaaagtctgccgactataatcccaccaacggcctgccagccgggacactgctggagggcgcagtctttgagatcactgacaaagcaggcaatgtggtcgataccattcgctctaacagccgaggactggctgtttccaagcaactacccctgtcccgctactttgtgcgagaggtcaaggcaccggatcattatggtatcaatgacaaggaactgactgcctatctggaatatgagggtcagatcctgcgctttgaggtggaggacaagagcctgagtaccggcgtagctatcacaaaaacaggaccgaaggagatcgtggccggacagccggtgcgttatgcgttctccggtatcgccaacacctccaatgtcagcctgagcagcttctactggcgcgatacgctgccggcacaggtgcggttggataccgtagtgaccggcacctacaacagacccggtacttataagatcgtctaccgcgtcaacggcggcgatcaccgcaccctggccgacaatctgtctacgcagaagaactatacgcttgccgcatcggccacggcgctgaagctggcatccaatgagcgcgtgacagagatcatgttcgtgttcggacaggctcccgcgggttttgcacaggtagagaaaccgtacctccactgcaaggcggtgaccgggctgtccgcaggttccttcgtcaatgtagccgatgttggcggcacttatggcggcacctgggtacagggcatcagccgctgggtcacaacggtctacggaaaacctgtcattcccacactgcccaagacgggctattgactcacacgaaaactgcggcaggcgcatgaaacagagcgtctgccgctttttctatcccattcaacaacatatcaaacaaaaaaaggagaactgaactatgctgaagatcactgctattggtaacctgaccaacgatgtggaactgaaaatgaatgagaccaccggcaagccttacgccatcctgcggatcgcctcggaccgccgctacaaggataagtccggcaatcgcctcaccgactttatctccatcaaggtgcgcggtcctctggccgagcgctgcgccgagtttgcctggaagggctgcaagctggcggcgttcggtgatttcgagactatcacctttgagaatgagccggagcgtcagcccggtttcctcatcaaggccagcgatgtggagttcctctcgccccgcaaggcggaggcttctgctgccgcactggagaatgagagtaccggagaggtcgctgcctgatgaaaaataccgggatcacatataccagcgctgaacgcagacctgtgatcctgccggagatggccgagctgctcccgcctttgagcgcggagcagtctgccgctctggaagaggatctgctgcgaaacggctgttatgcccccatcatcgtcaatgaggacatggtgatcgtggatgggcataaccgtcagtcactatgtgaaaagcgtggcctgccctatacgatggcggtattttcctttgaggatctgttggaagccaaacagtgggcgctggacacacagaaaaaccgccgcaatctggaaaagtgggagctgggcaagatcgccctgaagctgaaacccgagattgaagccaaggccaaagccaacatggctgctggcggacagaatttccgccccagcgaggccgaggaaggtttggcaacattgccaaaccttccttctgttgaaaaagcggtagatacccgcaaggagctggccgaagcagttggtctgggcgaacgcacgatgggcaaggtcatgcagatcgatgagaacgccccggaggtcatcaaggaggctctggataagaaggaactttccatcaacaagggttatgacctgacccggcagcttcaggatattccggaagagcagcgggagcaggcggccaccgaagcgctggaatacgaaaaagcgaaaaaagaactgaaaaagcaggatgccgagattgaccggaaaggaaagatcgcagcgcttttctgtaaggcgtatgaaaaagccatcctgctgacgccgtccgaggaaaatgtccgctgctggacggacgggacgcggatgaccccggaggaaatgcgggataccgtgaaggaatcccgtgagattgcccaggtgttcgctgccattgccgatatcatcgagcagaagatcctgcctgcggattggaggtgtgtcgatgcaggaaacgaagaaaatggcgcccagccggacgggaatcccgcctgacgcgcaggcggagattttgcaaaagctgtctgccgaaacgaagattacttcctgtgagatcgcggagatcttgaaaaagcacgatgtctgcggagatatggacgcgctccaggacgcctaccggaaacggctgggacagcggctcctgtccggcatccgggacgagaacggcaagcgggaaatcctttccaccagcggcggcgagtatgtcatcgtagattgctgcaatgacccgcagaagctgaaagccatccagcgccgcattcaggcgcagatgaatgggctggatgtgtctgccgggaaggtgcatgggcgcgttcactttttagagcgctttatgggctgggtaagaaaggagcggtcagatggagcggcatgaggaaatgctgtccccggaggaacagtacgcgcagcttgcgccaacgctggacacagacggtttctcgctgtatgccgccgcggaagaagtcaccgggctcaaggtctatgaggaatttccctatgaggataaccggggaatgtttgagatggcagacggacacacgctgctgcggtatctggaagcggcatactttgggaccgttacctgggagatcgtccccggcacgccctatgagcgggcgattctcggtgaagtggataagaccacgccggagtatcgtgcgttttatcaaaaaatctgtgatggtgcggtgacacgcatcaaaaatcaacttgaaaaggagattcagaatgtgaaagaaccaatcacagagatcaaccgggattccttctggaacctgatccatgaggcaaaaaacgcctgcgggcaggatatggacgccatgctgacctacctgaaagaccggttggtttctatgggccccgcgcaggcacagaatttccacgacatcatccacgcctatgaagatctcgcggacaagtacggcctgtgggacgcggcagggattatgaaggaatacggctgcagcgatgacggttttatcgattttcgcgcctggatcatcgcacaggggcgcgaggtctattttgccgcgctggcagacccggacagccttgcggatgtcgttccctacggagattgccgctttgagcagttgagctatgtcggcgactatgcctatgagcagctcaccggcaaaagcgcctatgaccaggcggatcgggcaaggtatgaaacgctgctggcagaactggaacaggatatcgtctacaaaggcggtattgaatttcccagagagggaccggagctgaaacagtacctgccacggctctgcgcggcgcatcctggctgggatggtaaaacgcgctggaatgtgcagcaaaaggagatgcgggatctcatccgcgccggaaaggcgtatgaccagcaacagatggcccccaaaaagaaacagcatcgtcgcggaggtgaggccagatgagcgaatctatcatcatcggtgtggatcatggctacgctgccatgaaaaccgcgcatttttcctttccgaccgggttggtggcctatgagcatgagccatatacgctgaacgatgtgttggaatacggcggtaaatattatgtggtgggcagcggacgccagccgatccaaaagaataagacacagacggaggattactaccttcttacgctggccgccatcgcaaaggaactggcataccgcaatgccggaacggcagcggacatctatctggcagccggattgccgctcaccagcttcggcagggataagaaagcgttccaggactacttgtgccggggcggaaaaccggtgtccttccgctatgaaggacaggactatgccgtcacaatctccaaagtgtctctgttcccgcagggttacgccgccgtgctgacgcagaacggactgctggacgagccgtccgtcatcgttgcggacatcggcggctggacggtggatctcatgcggctggatgatcgtattcccaacgctgccacctgccgcagtatggagcttgggatgatccgctgtttggatgagataagcgaacagatccgccgcagcctcggcctgtctatgacagcggcgcagatcgagagcgttcttcgagccgatgccagccgcatggatgaggatgcgaaaaagatcatccgtcaggaggcggagcactacaccaagcgcctgctctctgccatcgcggagagcggcctggatgtccgagctatgcccgctgtatttctgggtggtggtgcggcactgctcaagcagtatgtctccgctgcggacggcctgtgccggcctatcattttggatgatgtgtctttgaacgccaaaggatatgaacgactgacggaacaaatggcgcaaaagtatgagcagtaacaaaaaacggctgaatctgtccttctccatgaccttccctgtccaacaaagagcatggaaaaagctgatggatatccccgccgggcagcgttccgccgctgtgtgccgcatgatctgcgaacacagagagcagcgggaactgctggaggctgtgcggcaggcgatccgtcaggaattgcagggcagccagacccaaatcacacaagcagcgccgcaggctggggatatcgatgacgatgtcctcggctttcttgcgtcgctgcaggaaggagatgacacgacctgatccgatactttgatatgttcgccggcattggcggctttcgatctggattgacccgcacgggcggtttccggtgcatcggtcactgcgagatcgataaatacgccaatgccagctatacggccatttatgagccgggaaaggaggaacgatactatccggacgcaacccaaattgaccccgcagacctgccggacttcgacctcatctgcggaggattcccttgccaggcattttctcaggctggccgcagacggggctttgccgacgccagaggcactctcttctttgagattgccagattggctcaagcaaagcgacctccgtatctgctgcttgaaaatgttcccggccttttatcgcatgacaaagggaaaaccttttcggtcatcctctccgcactggatgacctggggtatcatgtcgagtggtctgtgcttaacagcaaatgttttggagtcccgcaatcaagacgaaggctgttccttatcggatatcttgatccccgatgcgccgggaaaatattacctgtcttcggcacaggtggaaaagctcttgtacaagtcctcggagggccgcaaggctcccggatctatgacgcagacggagtagcctgcacccagactgccggcgctggtggcatgggcgggaagaccggattatacctggtgggctttaaccggaaagatgggatcgtcggaaagcgggatacagcaattccgctgaacgccagcgatttcagaggaatcaaccggaaccaaacacaaaacgctgtgctggtagacctttgcagcgggcatccaaagcaaacggacgctgcccgctgtctcaccgcccggtatggacagaccacactgtccaaccgtaaaggcgagcgctccggtgtcctgctcatcaaggaggcgaccaagaaggggtacaaggaggctcaacccggcgatacggtggatttgggctacgcaggcagcaacacccgccgcgggcgcgttgggtgtgatattgcccatacgctggaaaccagctgtatccaagggatcgtggaaaacggcggacgcatccgccgtctcatgccacgcgaatgcctgcggctccagggctttgaggaatggcagatcgaccgcatcctcgccatccagtccgatgcccaggcctataagcaggcgggcaacagtgtcaccgtcaatgtaattgaggcgattgccaagcgtatccaggcagtggacgaggaattgaaagcgggggccgcggcatgatcggaatgaaggatcaatacttcggcgttgaagtagagatgaccggcatcactcgtgagcaggcggcaacagcgctggccgcgtattttgcaacggacgcccgctatgtgggcggcgcttacgataaatggtgtgtgacggatcgggacggcaaagagtggacggtcatgagtgactccagcatccacggggagcagaagatcggcagcggctatcgtgcaacaggtgactacagataccgcgtggagatggtaacgccaaagcttacctatgcggaactgcccaagctgcaggaatgtgtccggcaggtacgccacgcaggagccaaggccaacagctcctgcggcatccatgtccatgtggacgcagccaatcataaccggcagagtctgaaaaacctcatcagcatcatgtactccaaggaggatatcctgttcaaagcgctgcaggtcaatgaaagccgggcgtcccgctggtgtcagaaggtgcgggaacccatgctgaagcaggcacgcaggctctcgtcggatgagacaagggatctgacgcagttggagaatatctggtatgagggggataacggcagcgcagaccactataactggacccgctattatgccctgaatctgcattctgtgttttatagaggaaccgttgagtggcgttgtttcaactcgacgctccatgccggaaaggtcgcggcctatgtgaatttatgccttgccatgtctgctcaagccattagccagcgcagcaccgttatgcggaaaacccatagcgacaacgaactgtttaccttccgcgtctggctggtacggctgggactcaacggtgatgagttcaagaatacccgcaatcatctgctggccaatctggagggtgatcgggcatggcgctatgacaaggatacttatgaagccaataaaaagaagaaaaaatccagagaaatggagaggtgaagccattgaagatacaaatcgaagaaaccgtctatgagggaacggccacagagatcatgggccgcctgcggaatcagaccttcgaccccacagagttccctgatattgagagctatatttggtttttacagagcaatgtgatccgcaccacaggaatggactgcccgctgccggatggcgatgtggaaacgcaggcgcaggccatgttccgccatctggacaggatcggcggactcagactgctggaggactaagatggaagaaactctgtatttcgcctacggcagcaatatcaatttagaacagatggcgcatcgctgtccagacgccctgctcgttgggccggtgacgctgcaaaactacgaattgcagttccgcggcagcggctttgctaccgttgcacccaagaaggattgtgtcgtccacggtctgctgtggaaactcacgccttcgtgtgaacagtcgctggatcgctacgaggggtatccccgccactacatcaaggaaacggtgacagtacagaccgcggatggctcaaaaattcccgtcatggcttacatcatggcggaaccgatgtgccgccagcccgcactgccgtatccacgctattaccgcgcaattcagcaaggttttgaagcaaacggcctgccggtggagtcgctggaggaagcgtggaacaggaccatcgatgaaatatgcaccggaacgatggagagacccgaccgacccaaaagcacgaaacatcgagatatagaaagatgatgaacacaaacggcagcgacagacggaagctgttgctgccgcttttcttttgaagaaggaggaacccatatcagcacagaaaaaatgaaagtccttgtggtgcgtcccatggaaatgcctgaagtgcaggagatcgaccacactctttctgccatgcaggagctcgtaggcggcaccattcaggcagtataccccttcgatgacccggtggcgctcgtctgcaatgacgagggcaagctgctgggcctgccgtggaaccgcgccctgaccgatgatcacggtgtgccgtatgacattgtctgcggcacattttttgttgccggtcttaaagaggatgattttgcctcgctgacggagcagcagatcgaaaagtacaaggacaaatacagccatgaaatgatcctttctgttccgaaacagccggaggcacataagaaaccgatgaaaaaggagaaacatgaatatgaaagataactgtattctgaccgccgagtcagtcaccgagggacatcccgacaagctctgcgacaccatcgcggacgcggtggtggatgcctgtcttacgcaggacgccgctgcccgcgttgcctgtgaggtcatggccacagctggaaagatcatcgctgcaggcgagatcacggcagcgaagattccggatatccctgccattatttgcaggacggtgcgggaagccggatacggcggcagcgactatgaggtggaggtcatcacccatgagcagagtcccgacattgcggaagctgtgtgcggcggcacggagaccggcgcaggagatcagggaatcctgtacggttttgcctgcgatgaaacaaaggagctgctgcctctgcctgtggtgctggcccatcgactgacccgcctgttgaccgatacccgcaggcagggtatcatccccggcctgcgtccggacggcaaggcgcaggtgtctgtggaataccgctctggagtcccataccgcgttgccgcggtggtggtatcctgccagcatgaggatgagctgtccctgccggaactgcgccgggacatcctgtgccatgtgatccgacccgccatgcaggaacttccgctggacgagcataccgaagtgctggtcaatccgtccggtcgatttgtccagggcggttttgaagcggacaccggactcaccggacgcaagctgatggtggatacctacggcggcctcgcccctcatggcggcggcgcgctgtccggcaaggatggaacgaaggtggaccgcagcggcgcgtacatggcccgttacattgccaagaatatcgtagcggcaggactggccaagcgctgcaccatcagccttgcctatgccatcggcaaggcacagcctgtggcggtgacggtggatacggagcataccggcatctattccgatgacgtgctggagcaggcagtccgcacggtattcaacctgacgccggatggcatgattggaacgctgggactggatcagcctatgttccaaaagttctgcaattacggtcacttcacccatgcggacgcgccctgggagcgcacggacatgacagaggtgctggaatgtgcctgtcgtgccaaggacatgggcgtatcgcaccgataacagaaaaggcccgcgagagatcgtctctcgcgggcgtgttatcactgcacggaatccttgaatgccttgccaggcttgaaagccggcgctttggaagcggggatttcaatagaggctccggtggcgggattcttgccggtgcgggcggcgcgctccttcacttcgaaggtgccaaagcccagcagctgtaccttgtcgccggacttcaacgcagtctgcagcgtgtcgacaaacgcattcagagcggtgtcacagtccttcttggtaaggccgctggcttccgccatggcggtgatcagttctgttttattcatcgtatttcgtctccttcatatctaaaatgactggaaatgatatgcgttattataccagactccccgcctgctgacaatactgccagaaaaaacagaatcagagaggatgatcacgatttcaaaagaaaagaagaaaaccctgcatatcgcgtcctgctccttcggcaaagacagccttgccacgatcctgctggcgctggagcatggtgaaccgctggatgaagcggtctactgtgaggtgatgttcgacaagacaacctccggcgaggtgccggagcatcgggcattcatctatgagaccgcgctccccaggctggaacagttgggcatccctgtccgtgtgctgcgttcggataagacctatctggacctgtttgtcggagccattacccgcggtccgaaaaaaggacttcgacgtggattccctctgtgtgggcattgctacattcagcgggactgcaagctccgtcccatccgccggtataacaagactctgacgccggatactgtgcagtatgtgggcatcgccagcgatgagccggtgcgcttgcgccgcttgcagggaaatcaggtgtccctgctggaaaaatatcactacaccgaagaggatgcaaagcagctctgccaaacggcagggctgctttcacctgtctatgcgtttacaaaccgtggcggctgctggttctgcccgaatgccaagcggaaggaactgcggcacctttatgacaaccatccggagctgtgggcgaaaatgctggagctgcaggccatgccgggaaaggtgtccgagaaattcaaccgcacggatcgcttttccgacatcgatgcggcattccgaaaagaagatgccctgtgccaaaaagcggcataaaaagaaaaggagatgagaaccatcagcaatcaaaaatatgagatcacagacatggcccacgaggaatatccgttcctgcaccgcatccgtgcgctgcgggatatctgcggcgagatccgcgcaggcgacataggcggtttcgtggaaagcgagagcaatctgtccgcggagccgggagactgcgcatggatcttcgatgacgccattgcagcgggtgacgcctatgtggatcgggatgcctgtctgcggggcgatgccattgcctgtgacagagcctatatttccaaaggcagcgtgatgagcggtcacagccgcgccgaggacaacgcctatctccgcggagcctccatgaccggaaaagcgctggcttccggaaacgcgcagatcattcacgatccccatacgatggggactcccatcctgtccggcaactgcaaggtgtatggcacgatacagggtgatgtccgcgtcaccggctccgccgtgatcctaccctgcgaggaagtccgcaacgatacaagggatacctttgtcctgagcggcaagagccgcagcgtgatccgcggtatcgggcgtgagaccttgaaacctctgcaaaaagaagtaagtcacatgaaaacaaaaacgctaaagaaacgaggtgtggagcgatgaccgtatatgagcaggaattgcgaaagctgtttgatcacagcgatctcgtggatcggcctcaattttccgggcgtgtgtgcgtgggagatctcggaaaggacctgcgtgtgcgggcggagtttctctctacccatatctccagccaatatgacgccatccgcctcacggtgctcaaccgcacggagggcgtggtggaccggacgctgctgcgctttcaggatgtctggggtaaaaagcaggtgccgaacaatcccaacttccgcagcggcgtcattccccacctgtgggatgactacggaaaagtggagtggtacgcctatcaccccactgccgaggactatgccgctctgcgggatgccgtcggtcagtatctgtccgcattccgggagcgcacgccggagctggaacggagcggccccaagctggtctatatctgtgctccgctgcggggcgatgtgacaaacaatgtagagtttgcgcggcagaaagcgcaggaggtgtttgcggaggggaatatccccatctgtccgcatctgctgttcccgcctgtcgcagatcccaccaatcccgcccaggacgagaaagccagggcgatgggactgcgcctgctggaatcctgccagcagatgaatgtgtacggtccggtctggacggatgggatgtggcaggagatctataaagccggtgagctgggcatccccgtgatgacggatcagacaaccattggccggacgccgcctgcacggcatcccaaaagaaaggagagataaatgccaattgagaggatcaccgcggacgatctgcgggatatggagcatcaggagggactggtgctgcagggctgtggcggcgcggcgcaggagtggctggatggcatcaacgacctgctgacgcaggacggcatcctgcagaatggcagccgctttgaaacggtcaaggtttttcagcacgatggactcactaatctgctgttccccttcgaggacattcaggtggacatggggaaactggcgatgtggcgtttgcagacccacggcgcattcggcggcacatggctgtccgactatgttcccaacaggctgggcggatttcgctccgcccggcaggagaacccccgccctctctgccctctgctggggcaggacggcaatatcttccatctggtgggtattgccgccagagttcttcggcagaatggcatggcggcagaagcgaaggaaatgcagacccgcatcatgggcggagcgtgccacagctacgaggaagcactgggaatcatcagcgaatatgtggaaacggagctgtctccgccccgcgaaaatcgaacgaaaaagaaggagaagcatgagcatgagcgataatcagaaatggagcatcctccaaggtgacgcactgaaggtgctgagtggctttgcacccggcacctttgacgccgtcatcaccgatcccccgtatgcctccggcggacggacccaagccgaaaagaacaagtccaccgccaagaagtattccagcatgggggagagtgcgccgcctccctttgatggggacgccaaagaccagcgctcctggacccgctgggcggcagagtggctgtatgaggcaagaaaggtatgcaggagcggcgcgccggtttgtatgttcattgactggcggcagcttccggcagccaccgacgccctgcagtgggctggctggatctggcggggcaccgctgtctgggataagggcaacagccgcccgcagaaggggcgcttccgccagcaggcggaatatatcgtctggggctccaacggcgatatgcctatcagccgtccggtcccgtgtctgccgggggtgttcaaatacggcaatccccagagtcgcatccatctgacggagaagccgctgcagctgatgcgggacattgtgaagatcacggagccgggtggtcatattctcgaccccttcgctggcagcggtaccacggtgctggcggctgtgcaggagggctataccgcaaccggcatcgaagtcacagacacctacgcggagctggcacgggaacgtatccgagccgagctggaaaaggcggcatgatctactgggctgtctggcaacactacttgctaaaacagggataagtcggtataataaaaacaatagaatggtgttacaagcgaggacacaggtatgaatgatcgaaacgcacaatatgatccggaaacgggaaagccgctggaccagtcctatttggaatgtggactgccggaagacctccacgaatccatcctgagaatggaggaatcatggaacatcattgatagcggcaggcaggataaccattgggatctctggtggtgcgacctgaatgcgctgatcaattcctatgaagtagagcaggtcatctcatcagaacaggcatggtatctgagaggaaaatatcttcgtatgggaaaggagtgagtgcagtgcttgattttacagccttacccacccgcaataagttttatgcaggagcaaatggcgcaaagatcgctgtcatttatgacggcgaacagtatatgctgaaattcccggcgctcgctcctaaaaataaagagttgagttatgccaatagctgcatttccgaatacattggctgccatattttcaacagcgttggtattgccgcacaggaaacgcttctgggaatctacagaaaaaacggtgcggaaaaaattgttgttgcctgcaaggatttcacttcaccaggaatcgtgctgcaggacttcgcatctctgaaaaatacggtgatcaattccggacacagcggctatggtacagaactgtctgatatcacacaagctatggaggaccagacagccttttcacccgcgctgctgaaacagcacttctgggatatgttcattgtagatgccctgatcggcaactgggatcggcacaatggcaactggggatttctgtataataccatgacggatgagatccacgtggctcctgtatatgactgcggcagcagcctttacccacaggctgacgaaagcatcatgcgaaatacactggaaagccagaaggagcaggatcttcggaccttttctctacctctctccggcataaagatcaacggacagagaatcaattattttaacttcatttcgtcgttgtcttattcggattgcaatgcggcactgaagcgaatccttccgagaatcaatatggagcaagtatttgcaatcatcgatgaaacgccatttgcgtctgacttgcaaaaacagttttataagaccatgctacaggccagaaaagagcgaattcttgatttctcaatgcgaaaattgaagaaacgggagcgttcagcgcacgaccatgattttgaacggtaataatgacgggcagggtgtcatcaagacaccctgcctcttctattttgggtgttacattgacaccctgtgtggaaggaccctgcgaaaccggatgtctggcgctgctgccagatatttcttttttctggaaaaggtacggaccgtgtccgcctgtattggaatcaacctacctctcaaaaaacgccccgccgacggcggggatcagccaacgccgccgtgggcggcgctggcgcaagcatagcgtttgtatgacaaacgcgcttgctggggcttgccccagtccccaatgccgcctgcgggcggaagattttgcggcagcgccgcaggaaaggagggcgatatgcccggaagaacgcacatgatctccgtccggctgaccgatgtggagcgcaggaagctgtcgcagatctgcgccgtctccggcttgccggtcagcgcggcggtccgggaaatgatcggcggcgttaccatccgccagcggccgccccaggaactccacgatctgtatgtggagatcaaccacatcggcaataacatcaatcagatcgcccgcaaagccaatgccggctttgctacgaaagaggatgtccgggaactgaaatttctaatgcggacgatagaggcaaaaatggcagaactggtgaagcagtaatggcggtcacaaagatccttgcccgcagaggcggtttggctcaggccattgcctatgtggtcaacggagacaagacggaggaacaggtgctgactgccgcgcaggggtgctcgatcagaagcgcctgctttgagatgcaggatgccaagatccgctggaataaaacagacggagtgcagctctatcatatcatccagtccttccgtccaggcgagatcacgccgggattggcgctggagatcgcgcaggaattcgtgcgggagcatctgcccggataccaggcagtcatcggcatccatacagatcgggatcacatccacgcccatatcgtattcaattcggtcaaccagcttaccggcgagaaatatcacagcaatgcccgaagctactaccagcagatccgtgccatttcagaccggctctgccgagagcgtggattatccgtcatcgtgcagagcgcgcctgccaggtcggtcagctacattgagtggctgcgccagtccaaggggcagcccaccttccgctccatgctggaggcagatctgcgggatgccatccgggacgccaacgacctcggccacttcttcctgctcatggagcataaggggtatgagatccatcatggaggcaggctcggcttccgcctgcggggacaggatcgataccagtaccccggcaggcaagatccgctgttcacagaggacggtatccgcactgccatccagggcaacctggaacagatcgaagcggggctgcggcctgtcttgcctgtgcgtccagcgtatcagccgtaccggaagcatcccaagtacagcggcttccttgctctctatgtccattatctctatctgctgggcaagatcgaaaagcggcagtacctgccccgcatgacgccgcatctgcggcaggcggtcatgcgctttgaacggtatcaggcgcagttcgcgttcctgcgggaaaatgacatcacaacgcctgctgacatggcggcattcgaacaacgcacagaggaaacgctgggcagattgacaaagcagcggaccctcctcaatgtgcggaagaagaaacgccagccgctctatgcggcgctggcagacgcggaggcgctggaacccagcagggcgttatacgaggaagggctcaccggtatggaagcggagttcgagaaatacatggaagctgtaaagcagttggagaaatgcggcatttccgcggaacggctgacagaagaaaaagccgagatctatgagcagctggcgagcctgaatcgtgagatccgggcggagcgccggaaactgaagctctgtcaggagatcagacagcaaattcctgctatggagcaggacatccagaacacagatgaacaccagaaggaggtgcaggaacatgaacatcggaggcggtgaagcggcggatcagttggtacgcatgatgctatccggcagcgaggtagctgtccgactgagcggctctgccctcaaaaatgtgctggcgctgagcatggcgctggcgaagaaccacaagacgatctccggaaaggtcaaccttgcgaagatgctgagagagacccgcgatgtgcgcaagtttaccatgtccccggagcaataccaggagttccgaaaacgagccggaaagcagaaactcctgttttccgccattcgggatacagacggccacggtaaggtggtggatgtcatcatgccggtcacagagatcgaccgcgccaatctgatctttggccgcatccaatacctcggccgaccggagcaggtacagcaggagcagcaggaaccacagcgagaggcgccgtccaaggacagagagacccgtacagcgcagggggcaccccaggtcgaacaggatcaccatccgcagaccaaagcccccgtaacgccgcctgtggaccagcggcaggaggtgccgtcaaaaaaaagatctcggtcgggacgcgactcgcccgctaccgtgcccaactcgacctcgtccaaagacgagagccggacgatgagtgaggaacgcccttctgtgctggaacgcctggagcgctacaagacacagctggatcagcagcagaagtctgccccgaccagaacgaaaaatcggcaaaagagcaaaaacggtaaagtgaaataagcattatagatcacccaaagcagtctcatcggcggatcgtgtaccgccgatgggactgctattttgttctctcggaggtggatcgcctgaaacaaacatccaagcaaagcgacctgatttttcgccttttcctctacatcccggtcgtctgggcagcgctgctcattgcgcagtcgatgggcggcggcttgccggagctgctgtctaagctgaccgccgcgctggagcatccattccagatccaatggacggacaagagtttgctatccatcctcatttgcactggcgcctacattatgggtctgtgtctgtatgacgcggaggggagaaggacgcgagacggcgaggaacatggttctgccatgtggggctctcccaaacaggtcaacgcgcagttctgccaaaagcagaataagatcctgacccgccatgtccggctggggctggacacccacaaacatcgacgctccctcaatgtgctggtcatcggcggcagcggcgcggccaagacccgcggctatgtgaaacccaacatcttggaggcaaacacgaactatgtcattacagatccgaagatggaggtgctgacagataccggaggctacctcaaacagcagggatacgatgtccgggtactgaacctcgtcaatttggatcagtccgacggctataacccattccgctacctgcgggatgaaaaagacgcgctgaagctggtgaacacgctgatccaggcgaccacgcccaagggcagccatgagtcggacccgttctggacgaaatccgaaacggcacttttgcaagctatcatcctcatgctgcaccaggaggcaccggagtatgaacagaatttctctatggtcatgcgggtgctggaatatgctgaggtccgagaggatgacgacgagtacatttcgccgctggatctgctatttcgtgccatagagcatgaagatccggagagcgtcgcgctgcggcaataccgggtattcaagcaggctgccggcaagacggcaaaaagcatcctgatcagcgccgctgtgcggctggctcccttcaacctgccgcagatcaaggcgatcacggaccatgacgatatggacctgtacacactgggtgagaaaaagtgcgccctctatgccgtgatcccggacaatgatacgaccttcaatttcctcgtcagcctgctgtactcccagatcttccagacgctttactactgtgcagaccagatccaccatggggcactgccgtgtcatgtccactttatcttggacgaagcgccatcggtcaatctgccggggctgccgcgggagcttgcgaccatgcgttcccgcaacatctcctgcagcaccatcatccagaacatggcgcagatcaaggaactctacaaggattcctgggaaaccatccccggcaactcggatacccttctttacctcggcggtaacgagagcagtacccacaagtacatttcggaggccctgggcaagtccaccatcgacaccaagacccatgggcagacgaagggacgctccggctcctactccaccaacttccagatgagcagcagagaactgctgaccccggacgaggtgcggatgctggacaaccggtattgcatcctgttcatacgaggggccagaccgattctggatttgaaatacgaactgatggagcatcccgcgatccgctacaccatggacggcggagcgccgccctatatccatcacgggacagccgcaccggccctgacgggagaaccgctgttccaattttattctaacaatgaaaaggagaacgctgcgtaatgaaacacgatttgaaaaccacgaactttgagagaaaggcaaagcgcgtctacgccgtccttgcctgcactgcgatggtgatgatggtcaccgcagttcccgcgctggccgcagacgacccgctgacggtggtcaacaacctgtccgattttattttctcgctgatccgtgccattggactcatcctgcttggcttcggcattttgcaggtgggtctgtccctcaagagccacgatccctcccagcgcgccaatggtatgctcaccgttgcaggcggcatcgtgatcacctttaccaaggagatcctcaacctgatcaccggctaagcataagaaaaaacgctgtggaccgcaaggtccacagcgtagcatttaaaggggcggcagaagcagaaaggaaagtcaggcacttcaatgatacaaaaaggacacatgacagcgcactcacaacatccgaagccgtagtcaaaaattgaataaccataggcaacacccccataacaactatcgacgattgccccatatggacgccgaagtcgcttgacggcttctttttctacacaatgcccccgctttggggctgacctaagtatatcctactcgacgccaatgatcaaggaggtgattttgaatgggaagtggaaactggatcgtagacaacctgaactccgcactggagatgtggaacggcagactggcggagatctggcagcttattaccacctcgccggaaaactttaagggcggcggtatctggaatgttatcgtcaatatcaacgatgggttgaaggcggtcggctatgcgctgctggtgttgttcttcgtcatgggcgtagtcaagacctgtggcagctttgcggagatgaagaaaccggagatggcgttcaaatgctttatccgctttgtgctggcgcaggctgcggtaagctggggcatggagctgatgacaggagctttccgggtagcccagggcatggtgaccacgatcatcgactcgtccggactgagtgccatgtcggccactacactgccggacgagatggtgagcatcatcgaggatgtgggatttatcgactccatcccgctgtgggcagtgacactgctgggatcgctttttatctgggtgctgtcccttgtgatgatcctaacggtgtacagccgttttttcaagctctacattgcgacggctatcgcgcctgtgcccttggccagctttgcaggacagccctccagcagtattggcgtagcttttttgaaaagctatgccgccatctgtctggagggctgcgtcatcgtattggcttgtgtgatcttttcggcgtttgcgtcctcgccgcccgccatcgcagacgatacgctggccgcagccaccatcgtgtggaactatgtaggcgaactgatcttcaatatgctggtgctggtgggcgcgatcaagatgagcgaccggatcatccgggaactgatggggctgggttgattcaacgccacaggccctcggtgctgatggtatcctcgccgttctctcttgccttgcggacgcgatatttgaaatattctacggcggcgcggtcatcctgcttctcctgaatgaagctccagccccgccccaacaaagaaaacagccaggacagaacgaccagaccgaccagcacgaacaggatattgtccgccaacgccgtatgtgtctgataccagccatgaaaaacggtcagcatggacaccgtgtacagcagcgggattgtcagccgggtcagtgcggcaaggcggaacaggagcgccaggacgccgagtcctgcgccgatcatccaaaacatcatttgccatgacctccttatcaagtttggcagatggtaacataaacggacagaaaaagcaagtatctgttcgggaaaactcagaagatatcggaggtggtacattggaggtacgcatcaacaaagaagtacgcaattatcaggaaagcttgtttttcggactgtcactgcggcagtttttgtttgccctgctggcggtggccgtggcggtaggcgtctattttgggctgcgccccgtgctggggcatggggagatcggctgggtctgcattctggccgcgttcccatttgccttgggcggttttttccagtacaacggcatgaatctggaacaatttttattggcgttttttcgctcagaatttctcaccccaaaacggcttgtgttcaaatcggaaaatatatatgcaaaactgatggaacacacatcgatgaaggaggcgctaaaacttgattaaaactctgcaaaccacactcaagcaggacaaagaacggttcaaggtaccgagatccgtacaagacatcattcccatccgccgcctctggccggatgggatctttcaatttggcagcaagtattccaagaccattcgcttcagtgacataaactacgccatcgcctccaaggaggataagacggcgatgtttctcagctactccgagctgctgaacgcactggataccggctccaccaccaagatcaccatcaacaacaagcggatcaaccgccacaattttgagcaggagatcctcatcccaccccagggagattttctggatggcggacgggcagagtacaatgccatgctgctggacaaggtgaccgactcctccaacagtgtcgtgcaggagaggtacatcacgctatccgcacacaagaagaacatcgaggaagcgcgcaccttcttcgaccgcacgatgggcgacgcggtctctcgcctgaaccatatggactcccgctgcgaggaactggactctgtggagagactccgcatcctccacgacttctatcgggtcggcgaggaaacgcagttccggttggatctggcggactgcatgaagaatgggcgtttcttcaaggatgccatctgcccggacggcatggaattcaaaaaggatcactttgtcatgggcaataagtatggccgggtgctgttcctgaaggagtacgccagctacatcaaagactccatgatcaacgaactgaccagcctgaatcgcagcctcatgctgtccatcgacatcatccccgttcccacagacgaggcggtacgggagatgcagaaccgcttgctgggcgtggagaccaatgtgaccaactggcagcgccggcagaacagcaacaacaatttctccgctgtggtgccttatgatctggagcagcagcgcaaggagacccgtgagatgctggacgatctcacttcccgtgatcagcggatgatgtttgccgtagtgacgctggtgcatctggcagacagcaaagaggaactggacagtgacacggagctgctccagtccacggcgcgcaagcacctctgtcagctcacgaccctgaactggcagcaggcggacggcctggtgacggcgctgccccttggtctgcgccgcatcgatgctctccgcacgctcaccaccgaggcattggctgtgctgatgcccttcaaggcgcaggagatctgggaccggggcggcgtgtactacggacagaatgccatcagcaaaaatctcatcgtagcagaccggaaacagctgctcaacggcaatgccttcatcttgggtgtttccggctccggcaaatcgttcagcgccaagaaggagatggtgtcgctggcgctgtccacgcaggacgatatcatcgtcatcgatccggagtcggagtaccggcccctcatcgaaggactgggcggtcaggtcatcaacatttccgccacctcgcccaaccacatcaacgccatggatatggagcagggctacggtgatggcgagaatcctgtggtgctgaaatccgagttcctgttgtctctttgtgagcagctcatcggcgccgggaagctgtccgccaaggaaaagtccatcattgaccgatgcaccgcccaggtctatcgggactacatccgcggcgggtatcagggacaggccccgaccctgcaggacttccacgcggagctgcttcgccagccggaaaaggaagcacaggatgtggcgctggccattgagctgtttacagacggcagtctcaacacctttgccaagcccaccaatgtggacaccaatgcccgtatcctctgctacgatatccgagaccttggcaagcagcttctgccggtggggatgctggtggtgctggacagcatcttcaaccgcatcatccgcaaccgcgggctgaagcgcaacacctggatctatattgatgagatctatctgctgttccagcatgagtacagcgccaatttcctgttcaccctctggaagcgtatgagaaagtatcaggcttgcggcacggggatcagccagaatatcgaggatctgctgcagtcccatacggcccgcaccatgctggcaaactcagaatttctcatcatgctgaatcaggcggccacagaccgggaggaactggcacgtctgctgaacatctcggataatcagctctcctacatcaccaatgtggactccgggcgtgggctcatcaaatgtggcagcgccatcgtgcctttcgtggacagttttccccgtcacaccaggctgtatcagatgatgacaacacgcccctccgaccttgttgcgtgatgtgctatgaaaaaaatcaaagaaaagcctgcgctctctgaacgcatcaaagaaaaagcggtatcgacacccagagaactgctgcacagaggtctggacgatggttcggagcggctgcggacgcagctgcgggattcggctcagcacgggcagacagacgagtacggcggcgataccattgaggataccaccgcccgcggcctgcgtcgggcagaaaaggaactcacccggcagcggaagaagaaaccgcaggagcagccgccggagggcggtgctcctgctgccgatgccacagagcaaaagcctgctgctatcaagggaaaagataccacttctgccgtttcacagccgcagaccgctgcggagcgtggacggcatcaggcgcgtcagaacgccgcgcaaaaagctaccaagatcaagaccaaagacgcctatatcggcgcacagacagagacacaggtcacagtggcagcggaaccgcagcggcaggggcagagagtatttatggaggaacgcgggcgcaaagccgcccgacggcaggcggagcaaaaacgagccgtatcgcggcaccaggtcaagacggcgcaagccttgcattcagacagggacggcagcaccatgcccgacaggaaacgttcagcacagactcctcgcattaaagagcgggcggcaaccagcttgccaaaatcggcgcgaaaacacagtctgccaatggaacggaaagtatcaccgactttgtctcgttcacgcaagacgggcgacgcggtgaaagccgcagagtccgtacagaagcaggcggccatgctgcaaagcagcgcccatgccgcacgggaagcagtggtgcagacaacgcggtatcagcaagccgcgaaagcggcgcaggccaccgcgcagaaagcatcccaggcggcgggacgggcgctgcgggtgatcctgtccgccgccagaagccttgcggcggcgatgatggctggcggcagtacggtcctctcaatggtgttagtcatttgcctgatcgggctcctgatcgcgtcgccgtttgggatattcttctccggcgaggacagcggcaccggatatacgatgccggaggctgtgaccatgctgaacgcggagttcacagaccgcatcgagcagatcaaggtggataacccctatgacgaactggatatggacaacgcgggcagtgccgctatggtggcaaattggcgggatgtgctggcggtctatgctgtgcggacaacgacagacggatcgtcaccggacgaggttgcgacgctgacagcagaaaagctggatattctgcgacagattttctgggatatgaacgccatctcttattgggtggaaaccatctcaggcgacaaggatgaaagcgataccgtcatcctgcacatcactgtcacagtcaaggatcatctgcaaatggcggaggaataccatttcacggcagaacagcacaagctgttggaagaactgatgcagccggagtatgaagaactgttcatgcggctcaccggcagctaccaggatattgcactcggcgataaggaagttacagagatcatgaaaaagctccctgcggatctcagcgaggagcgcaagcaggtggtgctgacggcgtatcagcttctgggcaaggtcaactatttctggggcggaaagagccttgtgcttggatgggactcccgctggggaacgccaatggaggtcacggcggcaggcagctctacgaccggaacgatgcgcccattcggattagactgttccggctttgtcgattgggtgttttacaaccagtctggcggcagttatgtcatcggccatggcggtggagcgtccagtcagcacagctattgcaccgatatttcatggagcgatgcccagccgggagaccttgtgttctatccgggagacagccatgtcggcattgtctgtggatttgacggaaacggcaatgtgcttatcatccactgcgccagcgggtacaacaatgtggttgtgacgggaaagagcggctttacatccattggccgccctaaatactatgccgattaaaaatacatctcatttctgagcaagcgcacccatccagccgcccgccgcggaacacaaacactgcctctaccggcggaggctcttcctccggcggcggcggtggcggcggctccagcagcggcaagaccgatacgacgaccaccaccaagcccgacggtaccaaggttcagaccgagaccaagaaggacggcaccaaggtggagaccactaccgccaaggacggcagcacttccaagaccacaaccaatcccaacggcagctccgtcaccgagaacaaggccgctgacggctccaccggcacggtgaagatcgtggacaattccaaggacttcatcgacacccggaaccactgggccaaggacgagatcaactttgtggcctcccgcgagctgtttaagggcgtcacggaggagcacttcggcgttgagcggacgatgacccgggccatggtgaataccatactggcacggcttgccggtatggacaccacccccgctgccgggcagaactggtgtgataagggcatttgcgtgtccgagcttcgctatatcaccgtggaggcggcactggcgggacgggccaccatcaccctcaactgtgattcacctgtgacgcggcaaaaagtgacaaggcgctataaggaaacaccgagtcgcacagagcaggcattttggtctgatgctgtgcgattttttcaccgggtagaatgccaatctgcacaggcgcttactatgcagcgccattcttagcatctacgcatagtgcatcgacaggaacatagcgcatcgcgtctcatactttggacggatttacatttttcaaggactttgctacaataaaacgagaagaaatttatagggcagaggtttatgacagcgagggtaccctcgctgtcccacggggttccccgtgggacaattcctctctgccgcagggagggaaatccgtgaccgacaaaagtgccatcatcgtcaagccgtctaccgcacaggcgtttgagaccctttggaaacgcggcagggtgctctttttcagcgcaccctgcggcttcggaaagacagtgctggccgatacgctgttggacgggcggcccgttctgcggctgaacgcggcagataccggctttgcgctgccctctctggaagatgcgtgggacatcctgctgatcgacaacattcaggatatgcaggaggaacgggactggcaggctctgtgcgcgctgatccgcgaaagcaccgaccgacgcttcttgctgctctcacgcggcataccgcccgcctgcctgatggcgtttcagtacgcgggcatgatgaccgttctcagcgcggaggatctgctgtttgaccgcgaggccatccgccgactgctgcaagcctgcggcgcagaggcgacggactccgagatcggcgcgattttgaaggagacctccggctatccgctgtgcgcggcgatcctcgcgcggcacatggcggcagggcagccctatggcgcggagctgaccgcacaggcatacggcgaggtatttctttattttgaaacggcggtctaccggcgcttcgacctgccgatccgccgctttctgctggagctgtcgccctttgagcgctttgatctggagttggcgcgcatggtcagcggcgacaacaacgccgccgcgctgctggatacgctgtggcggagcacgaccctgctgcaaagccgcgatatgcgaagctaccgcttctggccgcagttccgccaattcctgctctgggagctggacctggaatacacgacggagaaacagcgcgtcctgtttatccgcggcgggctttactatgagttaaaggaggacttctccagcgcactggactgctataccaggggcggcgaccatgccaaggtctccgagctgctgatccgcaatgcggagctgcatcccggcatggggcactatgcggagatggagcagtactaccgcgcactgccggaggcggaaatactcgcctccccatcgctgatgcagggcatgagtatgctctgcgccctgagcgcggactatgacgggtcggagcgctggtacggatgcctgaaacagttcgtggagcgctgcggcaaggaggacgccgcaggccggcaggcacgcggccgtctggcatggctggacatctcgctgccgcagcggggcgtgaaacgcctgacggacacgatccctgcggtgttccaactgctgacaaataaggagctgtcgctgccgtccttctccgtcaccagcgcgctgcccagcatcatgaacggcggaaaggacttttccctgtggagcaaaaaggacgacctgctctaccgcaccatgcgtatcccggtggaggccgttctcgggcgggacggcgtgggtcttgcggactgcgccatcgcggagagtaagtttgaaaagggcgaggacatctcgccccggatgctcccccttgtgcagcgcatgaacgacatccgccgcggcggcacaccggacatcgagttcgccgccaacggtctgctggcgcgaagcctgctggcaggcgggcagagcgcggacgcacgaaagaccatcgccgacctgcacaggcaatttaccgaacgggagctgacgcggtttcttcccaacatggacgccatgctctgccgtatcgcactgcacaccggcgatctggacgaggccgacgtatggtaccgcgtcaaggcgccgcgggagccgatgcacatcaatattctcaaacgctatcagtatttcacacaggccatggtggagcttgccaacggcaagccggacagcgccctgctgacgcttacgcccatggagccatactgcaccgcctgtatgcgctacatcgacaccatccacctgaaggtgctgaccgccatcgccctgtatcagaaaagggatgaggcgtggcgcgagccgctgacagcggcactggcgctggcggaggaataccgcttcatccgcaccgtcagcgtttacggcgcggcggtgctgccgctgctggacgcgctggaatggtcgggaaatgcgaaatggcacaaacggctgatggcggatgtgcgggcacaggccgctatatatccacgttttttacagccaaggctttccatgagcgaggcactgacggcagcggagatgcaggtgctgcggctgatctgcgcggacaagagcaacgcggagatcggggagatcctgagcatccgggtctccacggtcaagagccatgtgagcagcgtgctcagtaagctgggtgtgaaccgccgcagcgaggccaggacagccgcgaaaaagctgtggctcatttccgaggaccaataaaacaatgcccgcacagagcgggtttcatatagaggtatacacatattccggaggaggatcatatgaagaaacgagtattgagcctgttcatggcactggcgctctgcctgacgctgctgcccacggcggcgctggcggaggagaacaccaccgagccgagcacccaactgaccgaacccacccccgtcccccaggagccgaagactccggaccaaggggagaacacggaaacccccgaccagccggaggaaccttcccaggacgaaccgcccgccgcagacgaaccgcctgcggttcagtcggaggcggcgccccaggcggcggaagtcccggcggagaacgccgtggcacaggtggggaatgtgaactacgccaacattacggacgcctttgccgcagtgaagcagtccgacggcggcacgctgaccctgctggcgaattgcataacaccggatacgagtaaacgattcgatatttccggcaattacacgctggatttgaacagctgcacgctgacgggacagctgtatctgagcaaaaccagcacgtccttgaccgtcaaggattccggcacaggcggaaaaatccaagctactgccggctggtcgccactgtgggccgatggcggagatgtcaccatcgagagcggcacccttgccacacagaacgagaaaggacaagcactggttttcggtcaagaggctgcctgcggcacgctgacgattaacggcggggtgtttgaaaccggatatgttcaaatcggaggcactggcggcacaacggttatcaccggcggtgcgttccatgaccttcgcgtcaacggggactccaagcgagtgaccctgtccggcggcacctttgacacggtgacgcgttacaagagcggcagtaccattgcgcccgcagacctgttagcggacggttatacctttgtcaaccggggcaccggcgtggaggtctctacatcacaggcagctgctctgaccaacgtcaaggtcgtctccgaaaagaccgcgaacgcttcggtttcgctgacggtggacggaaccgagaccccttacagaacctttgaagaagccctgaccgccgcacaaaagacgcagggcgggacgctgaccctgctgaacaacgtgaaccttgtgacacaggtcttcgtcaacagcggcacgtttaccctggacttgaacggccatacgctgacgagcgaagattccaataccatgattgtcaacggcggcagcctgaccattcaggacagcaaggtcggcggcgttatcagcagcaccagcagcgacggcaatgcagtctggtgcctcgacggaacggtcactgttctcagcggctctatcacgtccaaacttatttgggaatccggcaccgtttcacttcaaggcggggcgttccgctccttggagagaacggatggctcctggctgtcggcaatcccggaggggaaagccctggtaaaggacggccagattacggatgccagcgcaaagacaattcatacggctgccggcttttacgtactggccgaccacaaagaacatgattggcagacgggcaaatgtgcctgcggacgggaacacactgaccacaaatggaaggacggcgaatgcaccgtctgtcatcttccctgctcccacgggacaatcggcggggacggcatgtgcaaaacctgcggcacacagttcacggtgaaggcgaagggcaactattacaagcatctggccgatgctcttgcaaaatcgtccgttgatcgtgtgaccttggtggcggacgataccctgtcggaggatgtgacgctcatccaagacaacatcttcttctacccgaacggccacaccgtcagtggcaagggcgcaatcgtggtgcccagcggcaagtggctggaactcagagaggaagacgaaacggagaaagccggaaacgccggtgcgattcgggtagagggcgacggcacgctgatggtcggtgaggactttacaggaactgtccagacgctgaccgtcttggagaaggcagatgtcaagctccgcggcggtacgtatgaaaccatcacaggttcgagagaaaaggcggggacgctgctgtataatggtaataattatgccttggcgttcaaaaagcaggacggctcgtttgtgcggtatgaccagaggatttcatctaaaacgccgctggaaaacgtgaccgtggatttctgccggcatgaacagctgacggaagcgtgtgacggagcctgcgaatactgcaatgcagcgcttcgatgcagaatcggggcggctggctatcgggatatgagcgatgcgattcgcgatgttccagacggcggaaccattacgctgctgcgggactactctgcggtcaccaatatctcggcaaatgtcgaccgtgcgtacaccatcgacctgaacggccattcggttcggaagaacaacgacggtatcagcctggcggtgtatgccggtacgccgaagatcatcgattccaagggcagcggtgtcatcgccgggctggaaatcgacagcagtcttgacctgacgttggccgacctgctgccgaagggctgggactttcagaagagcgacggaagctggctgagtacgacggagctggaaggaaaaacggcgtccgatgtcaccgtggcgcagctccccatccagagcatgaactatcccaccgagatgagcatgacctatggcggtgcggggacgctgcttgtcaatgtgaagagcaccggcgctgtaaccttccagtggtacaaggtggaggacggcaacgagaaagcagttggcggtgcgacaaaaagcaatcaatttgatctttccgcacaaaatctgtccgcaggccagcacaccttccgcttttcggccacctgcgacggctacgagaagatgagcgaggatattgctgtgacggtacaaaaggccagcatcaggtcaacgcctcccacagcgcaggaaaacctgacctataatggccaggagcaggcgctgattattgcgggcagcgtggcgaactatggcaccatgcagtacagcctgaccgagaacggcacatacagtcagaacatccctgtcggcaccgatgccggaacgtataccgtgtggtatcgggtgattggcgatgcaaaccacaacgataccgcacccgccagcgtggcggtcagcattgggaagaagccgctgacgatcaacggggtaacggctgagtccaagacttatgatggcacgacaaacgcgggcattcccagcgtgaccttcgacggcgtgaccttgacccgagacacagactacaccgtcaccgccaactttgacgatgccagtgcgggcagcggcaagcacatcactgccacagtgaccttgatggagcaggctgcgaagaattacttcctgaagcagagcagcgtcactactactggcagcatcatcaaggccgccgcgcctgacttcaccaaggaaactgcgctcgtcattgtaaacggccacgaaaagacctacactgtgacgcttcccactctgcccacgctggaaacgcccaaagagtatggtgcacccacctatgagctcggcgagatcaaactaaatgacggctactacaccagcggcgcgaaggtggaaaacggtgagctgaccctgcccattcagaaaaatgacgtgacaaccaccggctctgtgggtacagtgaccgtggtaatcaagagcgcaaactatgaggacatcacgctgaccgtcaatgtcaatgcgaccaacaagcttgtccccactgttacggcacctacggcaaacgccctgacctacaacggtacagaacaggcgctggttacagcaggccagaccactggcggcacgatgctctaccggcttggcgattccaaatggagcgagcagctccccacagcgaaaaatgccggggaatacaccgtttggtataaggttcagggagacgcagagtacgcagatgtggcagaacagaacgtgactgtgaccgcagcgaaaaaggcagttaccgttacggcgcttgacaagagcgcccacaccggcagcaccgcgcccgatttgagcagcccggaagcagataagaattacaaggtggaaggtctgcttggtgcagacaccctgagcggcacggtaacattgacttacgcgcagacaccggatatgagcaaacccggcaaaaccgcgatcaacattgcgggtacgctgtcaaatgacaattatgagatcacttatgttcctggaacactgaccgtttccgatcggccttccagcggcggcggttcctccggcggaggttcttcctcctctgaccgggatacctccggcggcggcacggtcaagaccgaaaccaccaagaataacgatggctccgtcaccaagacggaaaccaagaaggacggcaccaaggtggagaccaccaccggcaaggatggttccgtcactaagaccaccaccaaccccaacggcagctccgttaccgagaccaaggccgctgatggctctaccggcaccgtcaagaccgacaagaacggcaacaccgaggcggagacgaaggtcagcaccaaggccgtggaggatgcgaagaagtccggcgaggcggtgaaggctcccgtggaggtcaaggcctcccgtgattccagcaccgcccccaccgtcaaggtggaattgcccaagaattccggcgacaccaaggtggagatccctgtcaccaacgtaaagcccggcactgtggcggtcctcgtccacgcggacggcaccgaggagatcgtcaagaactccctgcccaccgaggacggcatccagctgacggtcaacggcggcgcgacggtgaagatcgtggataactccaaggacttcatcgacacccggaaccattgggccaaggacgccatcgacttcgtcagcgcccgcggcctcgtcaacggcatgaacgccgttgcctacgcccccaacgcctccaccacccgcgcccagctctggaccattctggcccgccagagcggcgccgacctcaccggcggcgcgacctggtacgaaaaggcccagaattgggccaaggagaagggtatctctgacggcacgaaccccaacggcaccatcaaccgcgcccagatggtcaccatgctgtggcgggccatgggtcagtctgccgctgcctccggtgccagctttgctgacgttcccgctggcagctactatgcgcaggccgtggcctgggccgtcgagggcggcatcaccgccggtgtgggcggcggtcgtttcgaccccaactccacctgcacccgcggccagatcgcaaccttcctgtatcgctacatgaagtaagcgatccactttcccagcagaccccagcagcaaaaaggctcccaccgagaaatcggcgggaacctcagcttgtcgaaaaagtggcttcgccgcttttttgccaagctgcatagagtccacgcgctatgcgtggactctacacgaaaaacggaggaacaccatgagcaatgaaagaaaacaacggtatctttacatagacggacaagctgtaccgggggcagcgcaagagaaaacactttattcactccaaacctattgacacccaaaacgccgtatcgtaaaatacaggggaagggaaaattatgcgcttttttgcgggaaaaggggttgacaaactatgccgttgaacaatatacttgcgacagacagacagacagacagacagacagacagacagacagacagacagacagacagagataaatctgcctgtttttgtgctgtccgcatatcgctatagcagaggaagcagttgtccattccggccggatggataaccgcttcctttttgcattttttgatagaccagtacaggaacaggaggatgactatgaaattaaagaaacggatcgccgctctgctgatggtgggcgcgatggtatgctccactttgccggtaaatgtactggcggtggaaagttcagatcaaaatgtaggcggcttatgcgaacaccacacagaacacaacgccgactgcggctataccgagggcatcgaggggacaccctgcaatcacgaacacaccgaggactgctatacccttgtgacaagctgcgtccacaagcatacggcggactgctacccggcagaaagcgtgtcggataacacagccagcccgtccgatgcggaaaatcaggagccggtaaactgcacccacgagtgcagcgaggacaccggctgtatcaaaaaagaattagactgcaaacacgaacatgacgaggcttgcggctattcccctgctacagagggaacgccctgcacctatgaatgtgaggcctgctcgggacaggagcaaatcaatgcactgccgaacgtagaggatagccccagagaaaatgccgaagaaattgcagctctgctggctgttgcggcagatcctgcgaacaagccgacagagggagacggcacagaacaatccccctaccagattaccaacgcagaggagttgaaatggtttcgggatacggtgaatagcggaacaaccgatattcacgccagactgctgcatgacattgacctgaagaacgtcagttgggagcccattggaacccagaaaaagccctacaatggcacctttgacggaaacgcctatatcataagcaattttcggctgggggaccacactaagtcagacccaatttctgaaaagggccttttcggctggattggatcaggcggtacaatacaggatgtggttgtgaaggttgaaaacatcggttctgcgacgaaccccaacaatttcaatattaccaaatgtgggctgattgcggcgtataacaaaggcactatccggcgctgcagtgttatggtcaattatacgctctatgttgcgggggagatcggcgtcatcgcctaccaaaatagtggcataatcgaaaactgcctgagtgcggtggggacgggaacgggagctccaaaatttccgggtcgtattccggatgatgcctctgctgcgggcattgcctatgaaaattcaggcacaattaaaaactgcctgtttgacggtaaactccgaacggatgggggcacaggtaattcctatacagcgaaagactatgccattgcaagccctggtggtacaatcacaaactgttactattaccactcccaaccaagagtcggcgatgcaatatacgagggtgaactatacaaggacggagacaaatccacagtaatatccaagacgcagaaggagatgggcaccggcgaagtgacctggctgttaaatcaaaatgggaagaatgacatctggcggcaaagaaaaatcggctctgcggacatttctctggataaaagctacgggagggtcaagcaaaataatgatgggacgtattccattgtaactcctcatatacaccgactggataacggcacgcagacagaattcaaggaggttcgctctttggatgaaatcacaagagacacttcagacacaaaatactactgtctgagtgaaaatgtcgtactgagcacagtatgggcagctccaaatcgggacatttcgctttgtctgaacggaaagaacatcacagcccctgccggtgcttctgcaattaccgtaggcaccggcagcaccttcactctgatggactgtaaagagacaggcaaaatcagcggtggttcctccggcattgcggtaataggcggcacgttcaacctgcacagcggcgtaatcagcggcaataccaccggcgtactgcttaatggcgggagatgtacgctgaacggcggttccattaccaaaaacaccacaggtgtggattatctgaatggcacgcttaccctcagcggcggagcaaaggtaattgagaatcagggcggcgaggagaacaagacggaaaatattctgcttcacacagggaaaacgctctccttcgggaagctgaataccgctgcacgctttggcatttctgtagggaattcggattcctccgaggcacccatccccgttactgacgaaaccggcgggaaatatttcaacaacctcttcccggatgatgtgctcacaaacgagctgtatcaggagggtgatgtggtgtggcttcgcacacaggggcataaagcgcactgtgtctgtggaggtacacacaccgacattggcaatcatgcgcaagaaaagaagttaaattttcagccgtggaatccctatgcgaaagatcccgcaaagcctcagatgccgacctctatgcctgcaggtgtggacggctactacctgacacaagatgtcacgctgaatagcacttggagcccgtcgaatgtggtgctttgtttgaacggacataagatgaccttctccggcaatggtttcgtggagatttctggaaacggaaagttgacgctgaccgactgcgggacaaccggcaagctttgccgagagggcaatgaagtatacaagaaaggtggcatttccctctcaacaggaagcacctttgacatgtacggcggcacgattaccggctttcagcacggtgtatccaccgaccaagtgggtggaacaatccatctgtacggagggacgattaccggaaatgagactgtccacggtgccggcgtgttttgctggggcagtagtagaaatccctcaacattcatcatgtacggcggaaaaatcacaaataaccatgcaacctattcaggttcagatatcaacgtaaaaccgtcaggcggaggcgtatttctgagagagtacagtaaatttgaaatgtacggcggcgagattaccggcaacaccgctacttatggcggcggtgtgtactgcggtgcaatcataaaccccaacaccgcagagatgattctgcacggcggcaaaattaccggcaacaccgctacttatggcggcggcgtgtacttcaaggacaaagcctttcaggtcaccggcaaaggcaaggtaacaattaccgacaacactggaaatggcggaaaaaatgtggttttgtttgatgggaaaaccattcaggtaatggagaaactgcatgaagaaacccgcatcggtgtgacatcctttcatggccctaccgatggaaagtcgatccctatcgctaagacggaaaataaagactggatcaaggaaggaaacttcacctctgacattcccgactatggtatcgccctatcggaggacggcaaaatcgtgcagcttcagacacaccagcatagctgggagtacatcgtcagtcaggacggtacaactattacggaacattgtaaggcagaaaactgcggactgcccaaaggcaacggtggcagtgtgattatcaaggctcctgcggataatttgatctatgacggacaaggaaaggccgcagttctggaaaacacccttatctccaaggtgactgtatcggaaattacctataccatggatgacatcgattatgccggaacgcccaccgatgcgggcacctataccgccgctgttaccgtggagggaaagacagcaaaagtgcagtacaccattgcgcagtccgggactgagtttagcggcggagtgaaagtgagttcctatgtctacggcgatcctatcttcgtcactgtgacgcctaaggcaaccggcaaggctcctattaaaaaggtgcgagcacttagcacacctcaggcgggccagatggcaatttacgaaggagaaagacagcttactgaggcacaaacggttacctccggcaaagagctgacctttaccatcgacaccgcaaaagcgaagctcggaagtggatggcacacgcttaccgcaaaatttgtaggatcgcaaaatatggcagcgcaggcagaaacgaagcaagtatttattcggcaggccgggattgcaagagcagatgttgcggtagagggcaaatcgtttacctatacaggctctccgattacccctgctgtaagcgtaacattaaaaaatggaacacagctcattgagggcaccgattatacgcttgcctatacgaatcacaccaatgcgggcacagcaaccgtgaccgttaccggcataggcaactatatcgatacagcaaaaaaaacctttgtcatcagcaaggcagcggcccctgaaatcagttggccaacggcaagcgcaattacctacggggaaaaggtgtctgacagccgcttgagtggaggcagtacccaatacggtacattcgcttggtcggatactgtaaaggatacgactcccacagtgggaacttccccgtacaaagtggtgtttactcccagtgaagctacaaaaaacaactatgaaacgattaccacaacggagaaggatgtttccctaaccgtcaatgcaaaaagcttgaacgatgcccgtgtgacggtatccggcagctatacatataccggtcaggctcaaattccggctgctgatgcggtaacggttcagttaaacggtaaaacaattcctaaggaccagtacacaattgctgccagaaataatacgaacgccggacaggcaatcgtgaccgttaccggcaaaggcgactataccggcacagcaagcggaacctttattatcggcaaggcaacgcctaacccgatcacaccgaccgaattgaacgccttctatggcgacacgctgaaggatgtacctctgccgaagggatgggcttgggatattcccggtacctctgttggcaatgtgggaaagcacacctttgctgctacttacatcgaggacaacagcggcaactacaacccggtacagaaaagccttacagtgaaggtaagccctgcttcttataagatcacgcttaccgggcaagcggacagccccacgcagattactctgaataaggctgtggtagaacccggcaacatcggcgcggcagtcagctacggcatgaataccaccaacacagcccccagtaagtggcaggcagagaaagtattctccggcttgaccgcagataccacatactacttcttcgcaaaggtgggggccaccaccaactatgcggaaaccatcagcacaggcgtggcgattaccacccccgaaaaagaggtcagcagcatttccatcaaaacccagcccgccaagctggcctataccagcggcgaaacgctggatctgagcggcctgtcggtgcaggtaagctatagcgacaacaccagcaaaaccattggctgggacgccaacaagctgaccgccgatcccgcccagggcacggtgctgaccgttaccgggcatagcggaaaaactgtcaccatcagctatggcggtaaatccgccgccaccgatgccctcactgtaacgcagggcacacaggcggccctctctatcaccggtgcaccggccaccatctataacggggacagctttaccctgatgctttccggcggctccggcaccggaaccgtcacctggaagatcatcagcggccccgcaacagtggatgccaacggtaaggttacggtaactggcaccggcgaaattcaaatcaaagcggtcaaggccgcagataccgaatacgcccagtccgagacaaccattgcgctgacagcggtgaagaaacccagcagcggcgggggcagcagctccggcggtggcggcggctccagcagctccggcgggggcagcggcaagagcgatacgacgaccaccaccaagcccgacggcaccaaggtccagactgagaccaagaaggacggcaccaagatccagactgagaccaagaaggatggctccgtcactaagaccaccaccaatcccaacggcagctccgtcaccgagaccaaggccgctgacggctctaccggcaccgtcaagaccgacaagaacggccagaccacggcggagaccaccctcggcagcaaggccatcgagaccgccaagcgcaacggcgagccggtcacggcccccgtggaagtcaaggccacccgcgattccagcaccgcccccaccgtcaaggtggagctgcccaagaattccggcgacaccaaggtggaaattcctgtttccaacgtgaaacccggcacggtggcggtcatcgtccatcctgacggcaccgaggagatcgtcaagaactccctgcccaccgaggacggcatccagctgacggtcaacggcggcgcgaccgtgaagatcgtggataactccaagggcttcatcgacacgcaagaccactgggccaaggacgccatcgacttcgtcagcgcccgtgggctggtgagcggcatgagcgccacgatctacgcgcccgacgcctccgccacccgcgcccagctgtggacgatcctcgcccgcctgaacgacgtggacttgaccggcggcgcgacctggttcgagagcgcccagaattgggtcaaggccaagggcatttccgacggcacgaaccccaacggcaccatcaaccgcgcccagatggtcaccatgctgtggcgcgccatgggtcagtctgccgctgcctccggtgccagctttgctgacgttcccgctgacagctactatgcgcaggccgtggcctgggccgtggagaacggcatcaccgccggcgtgggcggcggtcgtttcgaccccaactccacctgcacccgtgctcagatcgcaaccttcctgcaccgcagctatctgagtaaatgacatagcaatgagaacagcggtcgtataatgcgaccgctattctcttaccgctgtcgagactgaaatttggggaaagagagcaaaggagccaccacatgaagaacgaatcacagcaggcactgctgcttctccggcaatacctacatcagcatacagatgaacagcatccggtctcggtcacagacattctcgcattctggcagcagcacggcattcaggccggacgcaagagtgtttacaccgacatcgaactgctgcagaatgtcgggatggatatcgtctgcgtcaaaagcagccagaacaaatactttgttgggcagcggcttttcgaacttccggagctgaagctgctggtggatgcggtggaatcctcccggtttatcacggagaaaaagagcaccgccctcatcaagaagctgggccatctcaccagcacagcgcaggcggaacagctgaaccgccgcatttacatgggcggtaccccgaagccggagaatgagagcatctactacaatgtggataccatccacaacgccgtccagaagaaacagcaaatcaccttccagtattttgagtacacgcctaaaaaggaaaagatactcaagcatgatggatacaagtatcggttcagcccctacgccatgatctggaatcgggactgctactatgccgtaggctggtcggaaaagcacggaaagattgcacaatttcgggtggaccgcatgacggcagtcgaaccgctggaacaggcggcagtccagacaccggactttgatccggcggagtatgtccgcaaggtgtttggaatgtatccggacgacctctgtaccgcgaaactgctgtgcgataatgaggtcatgcgcagcgtcatcgaccgcttcggtgaaaatgtgcggacggaaactgtagatgaacagcatttccgtgccacagtcgaggtcgcgccaagtcctccgttcttcagttgggtctttacctttagcggtaagattcgcatcgtcagcccagcagcagtgctggaggaaatgcgggatatggcagcgtggctgagataatttctgggtggtgttccctgcggggaacaccacctttttcacgtcttgccaatcgaacgaatgtttgctatactgaggctacagtgtttccagagaagagaacacggataggaggtgagttacttggaacagacattcggcagcttcattcgggagaaacggcaatctatcggattgtccctgcgcacgctggcggcaaagctggacttgtcgccggtctatctgagcaacattgagaacgaccgcagaccggcgccgacgcgcgcatatttggaacggttggagcaggaactgcatctgagcaaggtggaaaccgagcagatgctggatcttgccgccaagtcccagaataaccgggtatccgcagacctgccggactacatcatggatcgggagatcgtccgggccgcgctccgcacggcaaaggaggcagacgccacagaccaggagtggcaggaatttatcgaccgaatcacccagcgcgcaaagaaatccaaagagggcggtgaaatagacgcatgaaaaaagcatattaccgcgaacaggcgctggagcggatcgcccgcgatgtgatcatcgcctatgaccccagactttattacggttcccccgcagccattcccattgaggacatcatcgaggcacaggggctggtgctggagtatcagtatctgcggaataatgggcgggttttgggcgagaccatctttgacgacggtctcacagcgatctatgaccgggaaaaccaccgctatgaccttcttcccgtcaagggcggcaccatcctcatcgactgctctctctgcgaagaggaagcatctaccgggcggctgcgctttacctgcgcccatgagctggggcactggctgctccataagaaacagttcagcgggaccggcgaaaacgcggcgctccgttccggcgatgagagcgacaacacattggaagtgcaggcgaacctgctgggctctatccttctgctgccgctgccgcaggtcaagcgctgtttctatcagctgcgctccggacggacgaatcaacagctggtgacggatatggcaggtatctttcaggtatccaaacaggccatgcgcattcggttggagaaccacaacctgctgtaaaaaattttcatgtactgttctcaaaaaagagaacagagaaagtgaggcgctatgtcaaaaaccaattccctgcgctgtccgctgtgcggcaagggccgtattgcggatatccccagcggtgcggaacagtctcagtacaggctatttgcgctgcacagagcggaacaccctgacctgatcgccaaatgccccaagtgcggcgaacagatcggcatcacggtgctgacaccggatgctcaccccctgatccacacgcccatcccctttatgggatatgttcaggcataaattaaaaatccaattgatatgacttcgtcaagcgcaccagccacccatcatcgaatatgggaacattgagttaggagccttacaagtagcttttcagctatgcgtaaggctctttttttgcgcctttctttggctgaaaagcggaaaggcacacaatgcgcagacgctggcaaccctatatcgctaaatatccgtgaccccatctcagacatttcaaaaaaatctgagattggagtcatgaatcatgaaaaaatggcaggaagaacgcaactatcggcgcgttcgaaacgaggctggcgaagtcatcgccaatatcatcactgtagacggcatggatgtagaggtgccggaagatgtgtatctggcctactcccaggcagaccgccgtgagcgctacatcacagaggaacagtcctccggaaaactgctctctctggagcagatggaggaagatgcgcttttgccggactatgtcggagcagaaacggcccccagtgctgaaacggaggcactggagcgtgaggaattccgagatttggcagagcagaagcagatccttttgctggcgctgctgtcactgacggatgatgaccgggaactcatcaacgccctgttcttcgacggtgcgtctacacgggaatacgcccaaagaatgggcgtcagccagcgggcggtcatcaagcggagagaccgcatcctgcgggatctcaaaaagttttttgaaaattcctcgaaataagggtattcaccgaacgcaattttcgggaggacagtgaggggctccgaatcgcccctcgctgttccttgaaaattgcataccagcaatacggataaccacccggacagaagagcgatccgcgcagtgtgcgccacaacccgtgggaagccttgcagcttcccgcggcgagcgattttacctgcgcaggggcggcgttggcagcgccgcccgcagagacgctgtccgggcagataatgagacacaatgcactggccagcatgaagaggctgggctgctccgggattgaaagcagtagagatcccggaaatacgcccgtgaaggtcttgccggaccttgtccgtattgttcccttttctcaccggggcgcgcgctgcaaatacggtggaaacgaaaacaaagcatgacaggaaaagaggtaattatcggatgaataccaacgataacaggctgaaagcccataaactgatcgaccatatttttcaggaccttcttcccgcccacggtatggcacagcgcccggagcagatccaattgagccaccggatgctggacgccatgcaggacgggaggatcgccctgtgcgatgccgggacgggcatcggcaagacctacgcctatctggcggctgccacggcagcgtctgcttttccaacagggcagatcgcccgccccatcatcatttccacttccagtatcgcgctgcaaaacgcggtgctgacggagtatctgccgctgctgtcctgcgttttactggcagacgggattcttaccaagccactgaaagcggtcatccgcaaaggcaaaagccattatgtctgcgatgagcgattggacaggcggctgcgtcaggtatatcctgcaaagaaaaatccggaagcgttggcagcgctccggactcttaaggaaacgctggacatggacggcgtttcccatctcagcggctatgaccgggagcgtgtctgcgtaccgcaggtctgcgactgcaagcagaaggactgccgctatcagcggtttctcaagacctgtgacaaaggtcaattcctgtttcaaatctgcaatcataatctgctggtggcagacgccatccaccacagcgagggaaaacgccccatcttcccggagcacggcatcatcatcgtggatgaagcccataagcttccggaaaccgcacagcagatgctgggtgtgacgttggcggccgaagagatacgaaacctgatccttcagctaaaaggggaacggtacttactggcggcagaaatgctggaggacagcacaggtcctttgctgcgcaagctggcacagcccagagaggaagcggagccggtggaagcctgtttgcgattgctgaccgcgccatcccgcacgctgcccatcatccagcggcagattggcagcctgctctccccgctgggaagctgccagctgaatacggtgctggatgcagtcaggctgttcaccagttcccagacagatatgattttttacactgccgaggatgccactacaggcggcgccatgctgtgcgccgcagccggcgatatcacgcagcgaataaaaaagatcctgtggcagccggatcaggcgtttgttctgacctccggcaccatggcggtgggcagcgattttcgccgtttcaaaacacaggcgggattggagaagggacaccgtgtcatggaatccgtttctccatccccctttgactaccggaacaactgcctgctctaccttccgcaaatcccgccccgccagagggcggagaacacggatgtgtactttgatgagttgactgccgagctcgtcggactcatcaaagcagccaccggtcacgcgctggtgctctttacatcctacgcagccatgtcggctgtgaaggagcggctgcgggaggaatctctcccattcccactgctgacgctgggccgcaacgcgccccacatcattgaacagttccggcacacgtcgggagcggtgctgctggccaccggcgcggcatgggagggctttgatttccccggcgactgtgtatctctgctgatcatcccgcgcctgcctttcgcctacccggacgcacgaaaggaacgggaattggagaagtattcttcccttcacgcattcatccgtgaggtagctgtaccggagatgcagatcaagctgcgccagggctttggacgggccatccgcacggagagcgatacctgcgtcatcgccattctggatgaacgggcctgccgtggccgcagatacgcccaggctgtgagtgaggcattgccggaaatgcggaggaccggcagcctgcgggaagtgacaaggtttctgcgggagaaaaagccggagagctattttgaggtagaaagatgatcgacgcaaagaaagaattgcagtatcggctggcagtccggatgctggagcatctggcggaaatcggcctgctgagcgcggaagaactgtcttacgccaagagactggccagagagaaatattccccgcagactgtttgggaatagtgctggatattctgcggatcgtgtggtagcttgtgtgttgacaaaaaagatacagggaagtgaaaaacatggcacaggtaaaaatcatcgcgccgcagacgcgggaagcggaacatctgcgggtggcagcctactgccgggtcagttcggactccaaggatcagctgcattcctacgccgcccagatccgcaattatacggaagagatcgcccagcatgacggctgggagctggtggatgtgtatgccgacgaagggctgaccggcacccggatggataggcgggatgacttcaaccgcatgatgcgggactgccggaagggtaagatcgaccgcattctggtgaagtccgtatcccgcttcgcccggaataccagagactgcctgtccgctctgcgagagttatccgccatgggcgtcagcgtccggtttgaaaaagaaaatatcgacacgaaaacgctcaccaccgaactgatggtgagcgtttccggttctcttgcccagcaggaatccatctccatctccgccaatcagaagatgagctatcagcggcggatggagcgtggggaatttatcacctgcaccgccccttacggataccgaatcgtaaataagaaagaccttgagatcgtcccggaggaagccgccacggtgcgctggatcttcgacgcatacctcaagggacgcagctccggatggatcgcggagcaactgacagcaaagggcatcccctcccagtctggcgcggaatgctggagagaaacgggaattcgatacctgctgaccaatgaaaagtacatcggagacgccctgagccagaaatcctacagctgcggcttccccttcgtgcagaaacgaaatcacggggaacgcctgcaatactacacagagaactcccatccagccatcatagaccgggacacctttgagcgggtgcaggcactgctgcaaaagaaagcgcggaaagagaaaaagcgcagagaaaaaagcccccttgccttaaaaatcgtttgcgggaactgcgggacggtgtttcagcgccgaagcagccagagcggatatgtgacctgggtctgccgaacccacgaccaccacgccgcggactgccccgtgggccgcatcccggaagcggagattcacgccgccttcctgcggatgtaccacaggctcaaaagcagcgcggacatcattctggctccggccctccggcagctgaatacgctggacacgatcctgcggcagaatcatccgcagatgctggccatcaaccgggccatcgcggaagctacagaagaaagccataagatcagcactctgcgggccaattgtttgctggacgcggatatctgcgccgcccgtatgaatgccatcagcgccaaactgacgcagctccggggagaacgccgccggttgtcggaaaacgaggctttggatgaaaccatggatgccattcgcaagatgacagatgtcataaagaatgggccggaacagatgaacatcttcgatgaggacttgttcgacagcttagtggaaaaggtcatcgcagaatctcagacacgcatccgcttccggctttatggtagtttagaactggcagaacaattggaggtggcggcaagatgacaaaccgaaagattttatatgggtatcagattcgtgacggcgcattggtgattgtgccggaggagcagcggaccgtcagtatggtctttacgctctataacgccggggcttcctatcaggccatctcggacgccttgaaccggcagggcgttccgtattgcctggaagtgccgctctggaacaagcacaaggtaaagcgccttttggaaaatccccgttacaccggtaaggagggataccccatactggtggaagcggatattttccaagcggcgcaggaaaagacggcggaaaagaatgccaggaagcagtcccacggagagaagcctgccattgcgcggttgactccatacttccgctgcgcctgcggcgggaagatgacccggctgggcggcggctggcagaacagcggcaagctgtatctgagatgcgaaggctgcgggactaccgcggtcgtggacatggaggcgacggtaagcgagactgtccggcagttccgagagcatgagcagcccagctgtaccgcctatgcgccctccgcggaggtcatgcggctggacaacgccatcaaccgggggctggagcagccggactcgccggaagcggtgatggcgctgatcctgcagggtgcggcagcacggtatgcctgctgcccagcgccgtctgccgaatctaatcggtctgagcgcttgacagagacggattggagacgcttccaacgagcggtttcccatatcaccatctcacaggataccgaagtaactcttatatttacggataaaaaagcgacaggaaaggacgaataatccatggaagcgacagcagccaccttagagcggcgggtgcgggtgatccccgcaaccagaaaaccggaagaactgcacagaaaccatgacgggaaaatgcgcgtagcggcctactgccgcgtctcgacggacagtgaagagcagctcaacagctacgaagcccaaaaaacctactatacccagaaaatcgaggacagcccggactgggagatggcagggatctatgccgatgagggcatctcaggcaccagcctgaaaaagcggacacagttcaacaagatgatcaccgcctgcaagcggggacacatcgacctcatcatcaccaagtccctctcccgctttgccagaaacacggtggactgcctggatacggtgcggctcctgaaagcaaacggcattggagtgtacttcgagaaggaaaacatcaacaccctcacggaatccagcgaatttctcatcaccctgttcagcggctttgcccaggcggaatccgagtctctcagcaagaatgtcgcgtggggaaagcagaagagcgcggaggcgggaaaggtcaccttccagtacaagaagatgctgggataccggaagggggcggacggacagccggagatcgtaccggaggaagcggagatcatccgccgcatttaccacaggtatctggacggctgcaccctgggacagatcaagcgggagctggaggaggacggtgttccaaccgcacagggtgtagagcgctggtctccctccatcatccacaatatcctgaccaatgaaaagtacattggagacgccctgctgcagaaaacctatgtgacagactgcatcaccaaaaaggtcaaaaagaaccgcggtgaacgcacgatgtactatgtggagaacagccacccggctattgtctcaagggacctgttcaatcaggtgcagcaggagatgacgcgccggtccagcaaacggaaggtgctgcaaaagagcggaaaaacggaacttgggaaatactccggtaaatacgcactaacagaattgttggtgtgcggcgagtgcggctccccctacaagcgggtcacatgggccagaaatgggaaaaagcgcatcgtatggcgctgcgtctcccggctggagttcggtacaaagtactgccagcactccccgacactggatgaggtcaagctgcacagcgccaccctcgcggccatgaacgagtacgccgccatccggcaggaggtctgccccgatgtgctggccatggcggaggaagcaaggcaggcgttatctcaggccggtgcacggctactgcagctgaagaagcgtatggatgcggtgagccgggagcaaagcgatgtgctggatcggctgctcgtcaacatggccgataccgagctgaatgccagaatgaaagcgctgacggatgagaaggaatccctcaaggcacagatcgtggacgcgcagcaggtagaggtcgatctggaggaacaggctgccagacgccggcagatgtgggacagcatcatggaatgcgccgcaggctatacggaatttgacaatgagctcgtccggcaggtcatccaaaagatcacggtggaggacgcggaaaccatccgcatccacttccgagacagcaaaacggtgattgagcaggaaatctatggatgagaagatgaacggcggaatatccaccttgcgagggatattctgccgtttgtcttttcaaaaaggggttataaccgcagaaaccattgcggcacaaggctttgacggcggtatcttttctgtcgacacacgacatgtaaaaccgcttatttcgttgaaatgagcggttttttctttactttttggcgaaatataaatcgttgcaaattctcaggcgaccgtcgtggcgactgattaggggtttatgatagaaaaaagagcagcaattgctgctcttatcgttttactccacggttctacgtcatataacgaatgcttagccggagatgcagtcaaattctcctgtagcaaagtgcaaaggcgttgtcccaccgttctgccaaagccgtatcccgatactgccgcataatatacatcagcttttccgtaatatcccgctcggctgttgaggtgtaaaatatcttatatctttgcggcacgactctgaagcagctcctttacttgagcgtccatatcgcactgcgcagagatgcgtccgacagcaataaaactatcttcttgcagtacgattgtattacggtcttccttgcatatcaagctgaacttatttgacagaattcaatattattccggtcttccgctaagaagcaggtcgatctgacagcgtaccggtcctctccgtccggcgcacggttattcttagtgcggataaatctcaaaaatctcctttccgcttttgagctgcccttatagccgcacttctgccaatcggttgcaaggattctccaaatcgttgaagctgcatttgtccatgctattccgaagataccctgtccttactcctatccggacagggaaatcaagcattcaataaagaacgtgcgttctctttactgtaaatcatactgtattttcgtatttttcgcaaaatcaattcatctatcgtgttaatttatgcattctttctcaacggcagttctcccgcaaatctgcggctgcacctgcaggagctccgctgttccctgttctccggtttgcatttttgcctgtttcgtggtatatttctaatatatgccgtatgactttgtaagcggtcatacgcgtcaatctgcgaacacatcatacaaaggtggggagcaaagatgaacggacctacattacaagtgcagatgctcgggcagtttacccttcgatacggcgaccgcaccatttccgacagcgacgaccgctcccgccgggtatggtcactgttggcctatatgctgtataaccacggccgctcgttcgcacaggaggagctgatccatctatactggagcaacagcgagaaaagcgcagatcccggaaatgcgctcaaatcaatctttcaccgcattcgcaccgcgctggacaagctgcagccgggacttggccgcctgctcatccgccgcaaagcaggacgatacttctggaacaacactatgccgctttccctcgatattgaggattttgaggcgcattttcatgctgccgaagccgccggagatgacgatgtccgtctggcggaatatcaggctgcactggcactgtatgccggcgatccgttgccgcgcgtgaccgatgaaatctggactattccaatcgtggcctactatcacagcctgtacacccgtgcggcagccggtgcgatcgagctgctcgaaaagcaggagcgcacagccgaagccgttgcgctgtgccgtcgggcaattcatattgagccgtatcaggaggatctgtatgagcacctcatgcgcggtctactccgcaccggcgatatgaagggcgctatgtcggtctacgaggaaatgagcgagcagctgtttgcgcatttcggcgttatgccgtccgagacgctgcgcacactgtatcgtcaggcgacacgcaccgtaaacgaccgtacactgaccatggacgaggtttgctctcagcttgcggagcccgcgccgcacggcggcgccatggtatgcgaatacgactttttcaaaatcctgtaccgtgccgaagcccgttcgatcgcgcgaaacggccattctgcgaatatctgccttctgtcggtctccggcaaggacggcgaaatgcttgcacgccgcagtctggaccccgcaatgaacaatctgcaagtgcttgtccagaacaatctgcgccgcggcgatgcgatcgctcgatgcagcatttcgcagtatatcatcctgctgccgcaggcgaattacgaaaacagccgcatggttgccgaccgactggtaagcgcgttttaccgtcggtatccgcactcgcccgcacggctccgctatacggtgcagccgctggcataatcagactttcaaaacaactgcgtgccgtctatcccacgcacaataaaggagataaacatgggtaaacaaagctggaagcccggcaacatgctcaatcccgttccggcggtgatggtcagcgttgccgatgaagatcaccgtcccaacatcatcacggtagcgtgggccggtacgatctgcaccaacccgccgatggtgtcgatctcggtccgtccgtcacggtattcttacgatattatcgagaaaaccggtgaatttgtcatcaatctcaccaccgaaaagctggcgcgcgcgtgcgactactgcggcgttgtcagcggccgtgatgtggataaatttgcgaaaaccggtctgacgcccatgccggtcgagcatgtcaacgcacccgctatcgcggaaagcccggtcaacatcgcctgccgcgtcaccgagagccgcgcactcggcagccataccatgttcatcgccgaggtggtcggcgtgacggttgatgacgaatatctggacgaaaacgaccggtttcatatcaacgatgcgaacctgattatgtactcccacggcgagtattttgcgctcggcaagtatctcggcaagttcggatacagcgtgcagaagaagaaaaagaggaagaagtaaggcgttttcaactgcatactattggctgaaatatcaaatcggaatttaaggaggtcttgtatgaagaaaatagtatgtacaatgctatgtattatgcttttatttggtttgagtgcttgtggtggagatgtcagtgaagtaaaaactcataatgttgaatctgagagctattcagaagaggatattaaagccgctattgacacaataaaaaaggagtttaagagtgactggaaaggatgcactctcacagaaatttactatgccggagatgactgcacaaaagatcataaagattgggcagacagaaacaatgcagatgaagtcattgttttattatcttcattcgatgttgattcatctggtggagacgggtctttgaatccaaatagtacatacagtgattggaagtggattttagttagaacagatggcggaaagtggcagcatgttgaccatggatattaagtcaaattccagttttccgcaccatgcaacccaaaacaacgcaaaaccggcatcttccgatgccggtttcttttcatttcatttctttatcaaatcgctgttcagcccagcattctgccgcgcagcagaatcgtgtgaatgttcagctcctcatccagcaggagcacattcgccagcttgcccggctcaagagagccgtaatcgtgctcaacgccgatagcgcgcgccggattggtggacgcggaacaaatcgcctggccgagcggaacacccattttaacagccgagcgcacgcagtccatcaaattggttgcggaacccgcaatcgtgccgtcgtgcagggtggcaaggttgccgcgcacggtaaccgcctgtccgccgagcgaatactcgccgtcatccagtccggtcgccatcatgctgtccgagatcaggataacacggttctcaaacagccggaaggtcgcgcgaacgaccgacggatgcacatgcacgccgtccgcgatgagttcaaccgccacgttatcgttgtcaaaggccgcaccgataacgcccggtgcccgatgagaaaacggcggcatggcgttgtacaggtgggtcacctgccgtgctccgtgcttgaaggcttcgcaggcggtgtcgtaatccgctgtcgtgtgcgcaatcgagatacgcacctcgcctgccagctcgtcgatcgtctccatcgaaccgggcagctcgggtgccagatcgcacagcttgaacagaccgccggctttttcctgcacccggcggaacatggccgcgtccggcgcatgcagataagcgccgttctgcgccccctttttcgcctcggaaatgaacgggccttccatgttgatgcccacaagcgccgcgtcattactctccgcctgataggttgcggcggcttcggcaatctgtgtcagcttgtcctccggataggtcatagtcgccggacagatggcagccacgccgatctgtgcctgatactttgccagtgtggagatagcctcatgcgtgccgtcgcagaaatcgcggcccatgcagccgtgaaaatgcagatcgaccagtccgggcacggcgtacagaccgcccatatccaccgcatccgcgctcacctctgcggatgcaatccggtcgcccgagatggacagtccgccggttttgaacgtgccgtccggctgatataccctcaaattgctaaattccataacttctcttcctttttagagcaaatcgccgcacttagacagtgccgcctcgtccgctacgatggaaacatctgtgtgcagctgcaggatggatgccggaacctgaggcgttaccgggccgaagaacgcttcacggacggtttccgccttgttttcgcccgaaaccaccagcacgatgcgccgtgccagcatgatggtctgcacgcccatggtgtacgcctgccgcggcacgtcatccgccgacgcgaaaaagcgtttgtttgcctcgatggtggactcggtcaggttcacgcaatgcgtacccttggagaaataatcgtccggctcgttgaatccaatgtgtccgttcaggcccatgccgagcagctgcaggtcaatgccgcccgccgccttaatggctgcatcgtagcgcttgcactcccgctcggcgtcaagctgcgcgccgtccggcagattgatgcgctctgccggcacattcaccgcgtcgaagaagtttttgtgcatgaaatagtgatagctctggtcgtgatcgggtgtcaggccgcgatattcgtccagattgaaggtcgtgcagccgccgaaatccacatcgcccttgttataccatttaatcagctgctcgtaaatgccgatcggtgacgaaccggtcgccagaccgagtacggaatccggtttgagaataacctgtgccgaaatgatgttggctgccttgcggctcatgtcgttataatccttagcgcgaatgattttcatggaatacctctttcttctgtctccggaaatagaaagggcaggcaatgtgcccgccctttccattgcgcggagcgcaatcgtgatatgcaaacaagataggttagttagattggttgcgatttcttaaccattcggtgttcccacgcggctgtatttccaaaccgtgtgcgagcacttcaggctgcgttgaattgctttcagtgttacttcagcatctttgccatttcgtcggctacgaactggaccttggtgccaataataacctgaactgcggtctgcgacggacgcattacgccagccacgcctgcagccttgatcttcttctcgtcgacgagcgtgccgtccttgacttccagacgcagacgggtaatgcagttatccagagattctacattttccttgccgcccagaccttcgaggactgcagctgcaatagcggtgaagtcgttattggccagcttggcattcttgtcaacctctgcgaagtcggcttcttcatcctcacggcccggggtcttgaggttgaacttggtgatcgcaaagtagaataccagatagaatacaacgaatgctgcgatacccagcgggatgatcatcagcgtgttgttcgctgccggcaggaaggacgagaatacgaggtcggtcgcgcctgcggagaagcagaagcctgcgcggaagccgacatagtatgtgatgatggtgaaaatgccgtacagagctgcataaacaacatacagcgggaagcacaggaacatgaaaccgaactcaaacggctcggtaacgccgcagatgaatgcgcagatggcagcggacaggaccagaccgatagcagccttcttgttcttcgcagccttgatcatagccagagccgcaccggcaataccgaacatcatgcaggggaagaagccggacatatacataccgaggctccagcctacgtttgcggaggtgtcgccggcccagtagtgggacaggtcgcccaggccgatggtatcgaaccagaatacgttgttcagcgcgtggtgcaggccggtcgggatgagcagacggttaaggaatgcatagatgccggcgccgatgccgtccatgccgataatgccttcgccaacagctaccagagcgctgaagatgacaggccatacgaacagcagaacaacggataccgcgatggaaaccagaccggttacgatggcaacgcagcgcttgccgctgaagaatgccagccagtccggaagtttcgcgtttttgaagcggttgtagcagctcgaaccgatgataccggcgataattgcgataaatacgttctggatcttgtcgaatgccagcgtttttaccggatcatccgcgattgcgggcatcagcgtggtgacaacgccggtgctcagcaggttggtcatcatcagccaggataccagaccggccagtgccgaagtaccctcgcggtcgtcggatagtccgactgcaacaccgatgacaaacagccatgccatattgtcaatcagtgcgccgcctgcctttaccaacaggaagccaatgttatacagtgcaccgctcgttgccgcgcccggcacgcccataacgcccggagcgatcgcgtagccaagacccatcaggataccgcagatcggcagcgcagctaccggcagcatcaaagccttgcccagcttttgcagttttttcatcataagagtttcccctccttattttgtggaccgccgaagcggccgattgtgttgacggatgggagagccgaactccgtttccgtccccctatttcatcgccgttcacacccggcgaaatgaaatccttacaaattactctcgaggaacgcctgcattgcagctgcagcggtctcctcgtcctcaccctcgatggtgagctttacggtatcgccgcacttgacgcccagactcatcacgcccatgatacgcttggcatcgacttcctttttcgggctggcgatcatgattttcgaggtaaacttgcctgcctccttgaccagcagtcccgccggccgtgcgtgaatgcccagtgcatccttgatggtatattcaacgattttcatggagaatacttcctttccgttactttttcttcagtgtcagcagtgcatcgcctgcggcgaccgcgccgctcgcggcgggctccacggtgaacgcatccgggttgcacacgaggatgggcgttacgatctgatagccctccgccttgatggccgccggatcgaactcgatgaggacatcgccttttttgacctgctggcctgccttgcagcacgccttgtagtgctttccctcaagctgtacggtgtcgatgccgacatggatgagcagctctgcaccgtccgccgtcgtcatggaaacggcgtgtccggtctcaaacatcacatcgatcgagccgtccgccggagccgtgatgcggccttcgctcggctcgatggcgatgccgggcccgaggatgccctgcgcgaacgtcgggtcgggtacactttcgagcgccacgaccgtgcccgcagtgggcgctgcgatggtgatgccggtatcaccgccgaacagatttttcagtttaccaaacattttgctcacaacctttttgattaagcaataccgcatgatcgaacaagcgtaatttgcgcggtgttgccttaagtatgcctattttgtccaaaaacatacagaaaataaaaagaaccaaacttctgcacagatacaacttgccctttgatggcaactcctgcgagaaatctggttttgcccgccgaagcggtaacaatccatttcaaacggatactgtttacttgttaattgcagtataacaaaagtttctcacgattacaagcagattttgtcgaatcgactgccaaattttcgccctgtttttctacactttgcacaaaaacagggcagcgtcgccggtttgacactgccctgtgagaatcatttctcatccgggtgctccatcacccgggcgatatggatggtgagatacagcagctcattctgcccggaatggaaccctttttccgtctgcacataggcgcggatgcggtccgcgcaggcgtaggcacgcgggtacttgaaccgcacgacctcgagcagatcggcatcctcgtccccgtacttttcgccgctgacgatgcgccgcgcgtagaatttcaggtgcgtgacaaaccgatagtaattcagcgattcatggtccggccggaagccgtattcttcgtaaacgatgccgaaaaccgctttcagcaggtaagtcatgtcgtaaatatcgcggatttcgccgccgagctgggcattgacgaagtgcagcgcgataaatgccgcctcgtcctcggtgaactccacgccggtctcctccttgacgatctcattcgccttgagacccacgcggaattcgtccttgtacagctgccgaatgtcccacagcagcggattgggcagtacaatgccctccttatagcggttgacggccgccgagatatgatcgggcagcgtaacgtaaatgctgtccgacagctccttgccgagcgcgatcttcgcatggttgataatgcgttcgctcatcaggaaatgcggcagcggaatgcttgttatcagctgctggaatcggtcggaaagctgatccgagtgcagcgtgaaccgcttttccaccttgtccggcggcgcttcgtcacctgcgcggcggccgaagcccagaccgcgccccataagcacagtctccgcaccgttttcatccagcgcgaccacaacattgttgttgagtaccttttctattttcacgtccgcgcctcctgacccgcaccgcagcacgcatcaaacgcttcacgcgccgcacggactgcattttcgtcgcactgccacaaactgaattcgctcagtccgggcagccccatcggcacattttcgcgccggaactgcattctgctgttttccacccgctttgcggaaagatgaaaggcattcgcgcctgttttcggctgcaaatcgcggataacatcggcgtttacgcctgcaccgaccagaatctgcacgtcctctcctgcttttgcaaccagcgcgcgcagcaaatccgcgcctgtggtgcagtccgcctgctgccctgaggtcaaaatggtatccacacccagccgctttgcggtttccagtgccgcaaacgggtcgcggcagacatcgaacgcacggtgcagcgtcacaccgcagccgcctgcaagcgaaatcagtttggccatacgttcctcatcaagatcgccctccggcgtgagcacgccgatgacaatgccgtccgcgccgagcgcggcaaagcgcttcacctgacggcagagcagctcaaattcgctttccgtatacaaaaaatcgccgcagcgcggacgcagcagcacacgaaccggtacggaaacccgttcccgcaccatgcggaacagatcctcatccggcgaagtaccgccgatcattaaattggcgcataactccagccgcatagcaccgccgcgctccgcgcttaccgcagactcgactgagtgggtgcaaacctccagaaccggtttcatttcctgctcctccttcgagacagaataacgcttggcaaattatgtgattcaatccacactgttatcggttaattatatcaccaaaagccatataggtcaacgcaggttttttcggcattctgcacaataaaaatcagatgttttcatataaataaaccacttccctgcttcgtatgcagagaggtgatctacagcattttccgcataatggcggctgatctcgaccatgccgcgaatatcgtcaatcggtgtacggatatcatggcattgacggatatttgccgtccatattcccaaaaaattctccgcgtttttggctgtttcttttcttctgctgagttgtcttgtcagtttgtataaaaatacaaagaagttttgtacaaatcggatagtttgcaggaattcgagcatacttatgcaaatagaccgcatattttgttgtttttttaacaattttgtgctatactgaatatacagcccataaaatggggaatgcgcgccggagcagttccgctgcaccgagccgacaggagaggtgttttatgaacagtattacgacccgcgtttggatcgcgggagcaagcggcagactgggttccgcacttagtcatcgtttcggcggcaacacagcatataagctggtaaccagcgaccgtgatgtagcggtcgaggatgtatccgttgtcggtcgttttgccgatattaaccatccggatgtcatcatcaactgtgccggtctgaccgacgtgcaggcctgcgaggcgaaccccgaagaagcgtataagatcaacgccatcggcgcccgcaatctggcgaccgctgcaagacgcatcgacgcaaaattcattcagatctcgaccgacgacgtattcggcggcgacgagggcaaggctttctgtgagttcgacgatccccatccgaccacgatgtacggcaagagcaagtacgccggtgaaaagctcgtgcgtgagctgaccgacaagcatgttatcgtgcgttcgtcatggctgtacggcgtcggctcgtacgactttgttgaccgcgtactcgatacggcggcaaaggaaggcgcggtccatctgccggaggatgagatttcctccccaacctcggcggaagcgctcgccggctttatcgactgcctgatgcacagccgcgagtacggcctgtttcacgcatcgtgcgacggctcgtgctcccgcgcagagtacgcccgcgaaattctgcgtctcgccggcaaggaaaacgtgccggtcacctcggcctccgagaacactgcgctgcgcccgcgctttacgctgctggacaatatgatgctgcgcatcactggtttgtatcaaatgccggactggcatgacgcactgagcgaatacatgtcccaccggcagacgggagtaaataaatgaatgaagtaaaagagaaaaagaaaatcggtctgactacaaggatcttcatcgcgctgatcgccggtgcaatcgtcggcattgcgctcaacatgttcgcagctgatgtggattttgtgcagaacgtgctggtaaacggcattttttatgttgtcggtcagggctttatccgcctgatgcagatgctggtcgtaccgctggtattctgctcgctgatctgcggcgccaccgccatcggcgacagtaaaacgctcggcaaggtcggcgtaaagatcatcggcttctacattttcaccacgatgatggcggttgccgttgcgctcggcatcggtctgctgatcaagccgggcatgggtctggatatgtcgcagatccagaccgccgaagtcgccgcttcttcggattcggtcagctttgcggaaaccctgctgaacatcatcccgaaaaacccgatcggtgcgctcgccaacggcgaaatgctgcaggttatcgtgtttgcactgatcgtcggcgttatcctcgccaagctgcaggataagacccagctggtaacgaacttcttccagcagggcaacgatattatgatggaaatgaccatgatggtcatgggtcttgcgccgatcggcgtattctgcctgatctctaagacctttgccggtcttggtttctccgctatggtgccaatgttcaagtacatgggcgcggtgctgctggcgctggtcatccagtgctgcggcgtataccagattctgctggcgctgcttacaagactcaatccgctgcgtttcctcaagaaattcgctccggttatgggctttgccttctcgaccgcaacctctaacgccactatcccgatgaatatcgacacgctggaggaaaaaatcggcgtcaaccgccgtatttcgtccttcaccatcccgctcggcgcgaccatcaatatggatggtacgtccatcatgcagggtgttgccgttgtattcgttgcacaggcgttcggcatccagctgagccctgcggattatctgaccgttattgcaaccgcaacgctcgcctccatcggtaccgcaggcgtgccgtcggttggtctggttacgctggcaatggtattcgattcggtcggtctgccggtcgccggcatcggcctgatcatgggtatcgaccgtatcctcgatatggcgcgtactgccgttaatatcaccggcgacgctgtctgcaccacgatcgtggcgcatcaggacggcgcactggataagtctgtatttaacaaaaattaaatcaaactaacaggaaaacccccgtatttcttacgaaatacgggggttttctggtgccgccagccggaatcgaaccggcacgggtttaactccgggggattttaagtcccctgcgtctaccagttccgccatggcggcgtgtaaatattataccagaacgggcacggtctgtcaaacatgtgcgccgccggtttgaggatttttcaatcccgcctctgctgctttcctgttgcgtccttccggaaaaagctatacaataaatataacaattctcctgcgcagaaatgagcatacggtacgcgttccatgccgttccggctatgcatttggcgtaccggttcgatgtccgaaaaaattttgaaacaggcggaacaaaccatacggaacaaacgtctaagctgatatatggcaatgaccccaccgcagcagcggccgtactgtcgatggcattcgttattgtcatatacaggatagagcgtataagcattaacagtgaaaaggaggaaaaaatatgaaacggtttcagaaggcgttaatcggtgttgtggtgagcggtgcattgctgttctcggcacaggcggcggaactgcccagtgcggcacacgatacgctgcaatcggctatgactaaggtacagcaggagatcaaggattacggtcaggtgaaaacgctcggctttaccggcgaaaactgcgagattatcctctcgaacctcaacgcgaaacagtatttggttaacctaacagctgacagcacacacaagtatggtattctggacaaagcaaccggcaagctggttgttcctgtggagtacgattattacattgcgcttgacggcacggaaacactggttagccagtacgacgctgatcatcaccccaactactggttcgccgatgaaaccggcaaactgacgccgatgaagctgccgtccggttatgagcttgcgacgtatgagccaaacagcaatgtgttcgtgctcttcaaaaacgtgaaaaagccggtatatgacccgtattccggcgatggtccaaccacacaggttgaggatgtcaccttctgtgctctagccgacaaagacatgaacatcatcctcgatgacatcgacatggtaccggattggtacgccgatttcttcatcgcaaagaccggcagcactaagtgggaacgtattgacaagtcaaatacgagcggcaacggcacctacggtctgtttgacccgaaaaccgaaaaatttgtcggcaagcacgattttaaccagattttctggtacgatcagcactttatcggcacacgcagcagcggcacaaaatcttatctgctggatggcaagggcggcgaaaccctgctgcccgcaaacgtcaaggagtacagcagctgggccaaaaccgaagtagctgccgcaggagagcacggtctcactgagtcattctcctatcccaggctggacattacccgcgaaaatttcaccaagctggcgatgaacctgtacaacaagatttatcccaacaaggagattccggctctggaaaccaagttcaccgactgcaggaacgacccgaacgtgaacaatgccgccgcactcgacattgtcaccggctacgaggacggcaccttccgtccgtacaagaccatctcccgtcaggaggctgccgccatgcttgaccgcctgtatcaggtactcggcggcaaaacggacgtggtttccgaaaaggccttcgctgacgatgccaaaatcggcgactgggcgcgcggcagcgtttacgcaatgcgccagaccggcatcatgcagggcaaggagaacaatcagttctgcccgacggacggctacaccgcagagcagtccattgtgaccatcgagcgcatgtatcaaatcatcaagtaaccagccatatcaaaaaggacttcgttttgacgaagtccttttgcttactcataacgtcccatgaaaatctcggttacgatgccgttttcgatggtgacacgcagcaggtccaccatcgtttcgtcccgtgcgtccggcgagccgtacagatcgaggaaccgtgcttcgctgtctccaacacgcagtccgcgcacggttttgtgccgccagaacagccaccggcgggtcagcggaatttcatccggtgcctcggtgatgataacgcggttgcggctcttatcccaccgtatctgcggaatgtggctgtcccacaggtacgaaaacggcgtgtacagcacgccattccgttccacgccggagacagcggtctcagcaccgtgcagtgtataggttttgccgtctgtcgtaccgccaaggcgctcaacgatctctttcagcggcacatacggctcgtttttgtacagaacaaccggattctccagcgtgatcggctctccgttctgcagggcttccctgctgccgatttccatgctgagcgacgtgttcgtccgctccagatagccgattcgccagaccgccagtccaatcgcaagcacaagcgccagcagcggcagccagtattttttcacaatacgcatgattttcctccctgattacgccttctgcgtcatacgcagcattgtgatgatcgactgctcgcaagtatagccattcttcggatcaaatcgattcgctcctacgccctgcatgataccggtttgcctcatcgcatagacagaatcctttgcccatacgccaatactcccgttgtcagcatagagcgtaggactgacttcgatatttccatacagcaccgtataaaggcgctgcaggataaccgccgcttcctgtcgggaaagctcgcgcgtgggctggaaggtgccgtcctcataaccggtaacaataccgagtgctgcaatctgacgcactacgtcttcatcgcagtcggagaacggctgtgccagttcaggcagattgatgtttgggtttaccgtctgaatggtttgccaagccagcttgcagaattcatcgcggtggatattcaggcgatatggtgtatgataggacagtcggagtccgtctttctccgcttgttcgactatattttcagcccaagtgctgggaacatagcagtaattcgcctgttcgcgctcatttccgttgctgtccaacagatactcggtcgtaccgtgacaaccaaaccagcgatcgttttcgttcgatacttcatcatagcgcgcgttgctgacgatcttgccgctgcggtcgatgaacatatatttactgttgaaatacagccgcggccacggtccaccgtccggcagataccagtcggacgcaccgacacggacagcggcgagatcgttataaaacagttcgctatcataagagtaatcatactgaccaacgttgtaatactggtcgatgccgtcctgcaggacggtaaaatccggtcccagcagcgtgtactgacggaacgtgtacggcattgtgccgctatcggtccgcacagttctggtgacggggtactggcaaaggacatatccttgatcatcgactgccagtacatgaccagcatgaggaatggatacatcggtcaagctgccgttcaggtcacacagctgatacctgccgccggtctccagcagcagctgatcattcgcagctttccacatgctgccgttgaacagcggtgtgatgatctttccggcggacagatcgaccgcacagatccatcggcttctatcgtcactcggggtaaatatcagctcccagatgtccttttcctcgatcagtcgacacggaaaaacctcgcagctgtcaattttccaagttttccatgtcggatatcccggataactggtatcctcttctggtgggctttgttgaaaatgcgtaattgcctgatgcgtaagctgcgtttgcgatgcggcatctgcggctccggcgccaatcagcatacagccgcacagcacgagtgcagacagcaaaaccattcgttttttcatgttccctatccccttgccagatgaattttagaccatatataatatataatctaaccgttctgcactgtcaactgtgacatgaaaataaattttttgagagaactttttcacacttttcctcgtctaacggttatagtaagcgaaggatttcacaggcaggaggtattttttatgaaacgatggcgttatttatgtgcagccgcgctgattgcaggcagcatggcggcgggagccagtgcggtatcgataccgagcactgctttaacacagttgcagcagcagtggcaggcagatacttccgcagattatctttccgcggacagcggccaatcccgcatagcagcgtatgcgctcgtgccaaaaaaaatctgtacaaaatttctgccgacagcttgtacggtattgccgatttgaaaaccggaaaaatgatcgttcccgcagaatataccacaatcgatgtgctgtcagacagcagatttctgctgactcgttatgaaaaccaggcttcttcgttctattatgccgatgcgagcggaacggtcacactgattcagataccggtcaaaggcacctatttcggcatggcaggcgatgactgtttcttcatcggtgtctatgcgaaacgtccgctgacggctgcagtatagcagcctgccgagcagtatgatattccgacacttgtgctgctcgacgaaaacatgaaggttatccgcgatgatatcgacggcgcttgcggtgctgcatccacgccgcattttacgaatggcctgatgccaattcagaccggcaatactttgtggattggttcccgaaaaggagctatcggcaacggaacgtacggtttgattgacaaaaccggccagtttgtcggcaggcacgacttcgacgagctcagctggacggacagccgctacatcggcaagcgcggcaccgcgctttaccagctggacggcaaaggcggtgaaatccggcttccggctaacgcttcgcaggaaagcagctgggccaaagcagaactggaagccgctcgggaacatgatatttcgctttctttctattatcccaggctgaatatcacgcgcgtggatttctgcagactggcggtcaagctgtatcaaaaggtgcagccgaatgcctccgcggctccggcagcggccttttccgactgcgagaaagagagtgtctgtctggcagcggcgctcggtattgtaaccggctatgatgacggaacattccgaccgtaccagtccatcacccgtcaggaggccgcccttattccccatcacaccccagccgcaagccgctgtgcgccgctctgacgcccttgcgccctatcccccatttgcctgtaaaagtgcgcaaaaaaagccgcccggaaaatgcacggtggccgtaaaacagtaaaattcaaaatgtcatgagaactgggtgttcttgggaagcggcgtgacttcggtcacgccgtttttccgttcatgagcacatccagagggatgaagccgatgccgtcatacttgatgtggatggtctggcggcgcttgccggtggacttgtccggggcctccacatagatgccctgaatcagctctcgcagggcgtagggcgtcaacttctcaataccgacatacttgtcggccttctggatgaaaaactcgatgttctcatgctgtcgttcctgtacttcaatttcctgttgcaaggtctgcgtttccgcttccagctgcttctgttccgcctcatagctctggctcatcatgtcgaaacgttcatcgctgagccgtcctgcggcgttgtcctcatagatcttgatgaacagccgcttcagctctgcgatccgcttctgattgcgttccagcttcttccgactaatctggatcttttcagtgctctccagccacatttgctgacccatggcggacacgaagtagtccctatggtgcaggatatattcggtcaccctctggatgtggtgcagcaccagacgctccagaacggactcccgaatgtagtgggtgttgcacttctccttgtccttccagtggagggaacaatcgaagaacgcctgctgcggcttatagttgttggttgaaccatagttcattttggagccacagtcgacgcagaacaccaggccggaaaacatactggttcttccgctgcgggtcatgcggtggcgctgctgtcggatctcctgaaccttttcaaacacatcatcctcaatgatgcgctcatgggtgtccgggaacacagcctgattttccagcggattctcccgctgcttcttgtcccagatggaattggtaaaggtcttgaagttcaccgtgcagccggtgtactcccggcgttccaggatgttgaccacagagctgtcagaccatttacagggattttccggcagagggtggggcgttccaaggccctgctgcttcttgtaagcggtaggcgtcagcacctgatccgctcgcagctgattagcgatttgggacgggccacggccctccatgcacatggtaaagatcctcttgaccaccagtgcggcctccgggtcgatgagccagtggtgagggtcgttagggtccttcacatagccataaggcacattgaccgtcaacgggattcctttctcgcccttggacttctgaacagcacggatcttgcggctggtgtcacgggcgtaaaactcgttgaaccagttcttgatcccggcgaaatcgttgttcacgctgttgggatcggcgctgtcgaagttgtcgttgatggcgatgaagcgggtgccgtacttggggaaagtcagcgtggtgtagaggcccgtcatagcggagtttctgcccaggcgggacaggtccttaacgatgcagttggccaccttgccagcctcgatctgggccagcatttcctgaaaaccgggccggtcaaagttggtgccggaatagccgtcgtccacaaagtacaccggattcgtcatgtggtgctctcgggaatacgaaagcaggatacttttttgattttcaatggagagcgactcgccggccctttcatcctcctgagaaagtctgcaatagagtgcagtaatcttttcggttgctccgaacatttctgtttcctcctttggtggagcaactgtcagtacagggctggttgtcatcatgttaacataacttttctcgtttgtcatgcgtcctcccccatctcagccgaaaaattttgtgcagtgatccgctccagcttgcgcagcatattctgagagccttcaaagcggccggtgacggtataaacggtcccggagatttcttccgtcaaggagatagacggaatctgataagcggaaatattccagcagtgcaggtttccgttttcgtcccggtacacagaactacgctttggggtttcggatgtacgctggattttgagataaggatcaaaggggatctcattctgttctggatcttcctcaaacaatcctctcagccattccaaagcatcctcggcctctgcaaaagcaacctcatggtcggtattttcatcgacatcgaatacctcacttaatgcccaatcaaaaaaactatcccactcgtcttcatcttccgttaatggaaggtgcagcatcaaatcgaaaaattcacaagccaatttccactcacggtcgctgaagcctttgtgcgcttccgggccaaaatcaattccgtattttccaaacatatttttcctccttgtctgttccattgtgtggaattgaaagaaggcagcaaaaaaggctgccacaaaacgcacctgtcctgcgaacgcagcagatgtgttatgtaacagccttactcttaaatggtaaaagcaaatactctgattcaaaatcagagtcaagtggggcttgcccacaatatgtcagaaaaataaactattcaattttaagttcattctacacgatgcggcaagatttggcaagtatttgcctctggtgttaaagaaaaattttcaatttgccacatagggcagatacagaaaatgaaggatttgttttcagagaaaccatcggaacgatggcacagccgctgccgcaaggcagcgttcgaagggttcggggcgttttcccaacaagcgatttacaaaaattgtgcggagcagaattttcgcaagcgggtaaacagggccctgtttacactgcttgcgaagctgtaaatcagaaaagtggtaccactttgcactgcttgccaagttgtgaagggcctcatccggagccgcccgttcaaaatccggtcatgctttgacttcggtccaattcggtctgaagttgaaaccagctgctgagaaatttccatgagcaaaatcagagggcctccggtttcccagaagccatctgctgatgtgttgcttaactatgtacggatcagacgccgaaaaagcacctgtcacaaagtggcaagcagtggaaacctgtacaggttccctcatttttgcagatccgcccgttggccgtatccgcaaaaatcgcttgctggaggaagcatccccagtcccctttgaaatcatcttcgatggtggctgcgcacaatttaaaagattctcaagccgcttctttgtatcgagtgtacacatactcataaatcttttgccgatatcccgaaatgctcaattcgtcataacattcaggaagctcttcccacaaggtatctcgaatcaaattatcgacagtggctctggtctcctgcttatccgtccagtgatccaattcagcgattttggatttgacttttgccaatacatccaccgctactttcttgattgcctggatgtccttccgggacagattatcagaaaagagcaaatcatacacagacagttcttcatcgctggagaagccttcacgaacatatctttgctgctcttcgtccatactgttggccaggtccatgagctccataaaggtcttttcgatggttgctcgatcctgctcaccattgtattctgcgatgatctgctgatacctttgcagataatcgatacgctgagggttcgtaatcagcatctgattcaaccgatcctgaatgagctgttgaagatcccgcataaccagattttgctttttatgcttggagaattcttttacaagcaacccaaaatcaatatcgctgatatcaaagcgctttgaagcaatcattccctcttgctgcggctgcacttccacatagtcgttcacaatatggttgatctccaccatcaggtctgtgttgtccgagtgttttcgccttttttgcaatgcagcataaattgcaaggatagcatcctcgtatgctcttgtttcggtggggatatcatttcgatccgcatatttcatcaggcgggccagctcgctggcgtaggtctgatattcttttttgatttccatagatgcacacatggcattggttgcatcttcaatcagcgataactgctcaaaggttccccgttgcgcatggaccagcgctgcaagatcaaacccgtaagaatcaaggaacgatgttgtaagctcgataatttcgtgaatccgtgcgatcagctctaccttatcaatcgtggggtctgtgctgccttgtccacccacattggctgtatagtcggccagtgcttttcgtagcgccttgacaattccaatgtagtctacgatcagtccgttgctttttccttctgccacacgattggcccgtgcaatggtctgcatcagggtatgcgctttaaggggcttgtccagatagaggcaggaaaggcatttgacgtcaaaaccggtcagccacatggcacagacaaacactacccggaacgggttattcttgtctttgaactccttatccaactctcgtttttccatctttgcacgatggggaagaatgtccaatccccactttttgaaggtttggatttcgttttgctcctggctgatcaccacagccatttcggtttcctgcatccatttcagcttatgggtcagctcctggacttcctgctgagaagcatgtcggatggtatcttccaggttggcgatctcctgagcccagtacttttgcaccagattgtacatccggacacaggtgaccttattcaggcagacaaacatggccttgccgctggtccagaggtctgaatagtgccccacaaaatcctttgcgatggagtcaaggcgtggttcagccgtcagcagatggatttccttggcgaattcccgttccagcttttcctgttgagacacatccagatctgcattttcaatggcgtccagaatacggctgttgatttctgggttttcaacgttcagaattttttcaccacggttttcgtagtacaggggaaccgttgcgccgtcatctacggctcgcttgaagtcgtagatggaaatatagccgccgaaggtgcgttccgtgatgttgtcgctggacagcagcggcgtgccggtaaagcccagtcgggaggccgtgggcagcagggtacacatgttgtcagcaaaggtaccgtactggctgcggtgagcctcgtccgacatgatgataatatcgtggtcgggataaataggcggctcatccggttgattgaatttctgaatcagggtaaagatgaagctgggatttcctcggagttttgccgccagatcagagccgctggaggcgatgaactgggatgctttggatgcacccaacagtccgcagttttcgaaggtgtcactgatttgcttgttcagctcgtctcgatccgtcagaatcacgatggtaggagaaccggcgaactttcggcggatcttctgagacaggaacaccatggaatagctttttccgctgccctgtgtatgccagaacacgcccaacttgccgtctcgcagttctctggtttcataggcttccacggcctcgtttacacccaggtactggtggtttcgggcaagaattttcacggtatgcccatctgagtgatcgaacaggatgaaattctccagcagatccagaaagttttcctttttgcagatgccccgaagcatggtttccaaggccacattgccctcgtcgtgctcagacaggcgtttccactcatggaagaactcgtatttgctgcccagtgtaccaaccttggcctccacgccgttactgagcatcaggaaagcgttgtagtagaacaggtgtgggatggtgtccagatagtcggtgtagttgtcgtcgtaggcgttctgcacatctacggtattctttttcagctccacaaacagaagcggaatgccgttgaggaagcccacaatatccgttctgcggcggtagtagtcaccgtggatttttaattccttgatggcaagaaagtagtttctggactggtcgtctgggtgctggaaatctaccaccatagcccgcttgatttcggagcggcctccaggctttttgactgtaacagggataccgtcccggatgtaggcatacttctcctcgttgatttgcataagggaagcggtagacaggcggctttccattttcttctgggcctcgtctatctgcataggcgtgatccagggattcagtgttttcagtgcctgccggaaatagcggattaggaggatttccttatagcttttgcggccgaaagtaccgttttcacccagaacctcggtgttataggcgaacttgacttcccagcccagttcagtttccagcagatgccctgcggcctcctgcactaagatgttttctgagtagtcgtagttcacaattacacctccactcctgctaaaagcttcaattttataattctttcatttatatttcttgctgaatttgaattttttagaagcaatttgttgtgtctatctgatctttcaattaggttgtatactttcttgaaattctctgcttgtatttcagagattgttgttctgtaccgtacaatttcttgcaatgaattctcgtctaaaaacaaaaatagctttccaagaagtccgacaagcatatccgaaacttgaatatatctattttcatgggatttaataaaatgatagttggtaatttcttctccgttctcgattaattgaatattctccaatcgtttttgaactgtgagttcttcatcaaagaagtggattgaatggctgaaaatttcacatctttccaaataaaataaataatattcttcaatcagctgaaaagaagtgttatcttgaacaaaaacgagtttatctatttttccggcttgcttaagcatttgctgtaatgtttccaagaaaaaaccaggatacaattcttcctcgttattatactgggaaatcagctcgcagagttctttacagaacaaggagcagtttgtaacgttgggatatgtatgcctatacagcagatctaaaatttcctcccgatgttgaactgtcaaatcatataatgcgctttttaactccattatgaattccatatcactaaataaatatgggtacaattcaaatagagagtccacaatatcaactaacgaatagtacaaattattgagggtgctataatgcacatacaaaccgctattttccaaccaagacaaaaaatcagatgctcgctgagaattcataaaggacaaaaaatctgtacttttattatacaaatgcttgaacttaagttccttctgcccctccataaaatgcattaagcgatatagtgattcaaagtcaacattatgttctgttccctgatatgctactccaccaagcaggaaattatgggttaatccttcaatggaattaacatctgcatcttttaaatagaatttacggcaatttcccgtttcatcgtagaaaaatgtataacaatcattaccaatagggataccagagagagcttgaaccatatctttttgtaagtttacatctattgtagtcaatattgcacctccattctgaataacttttcttagtagcgtgtttattggtattccggcttcaggaaggacacatttgcttttttcatacctttccagtcgtcggtgacaaggccgaccgaaaggctttcgtaagcgaacagccaaaactcatcaaaaactccgtttgccttaagctgtttagcgtagtttttcaaagtcttctgatctgctgattgttttcttttcctacaataaataagtgccatcaaatcgaaaatgcaatcttctttggagattacggtgttaacatcaaaagaagatatctcaaagtcatattttgtggcataatacaatgcaaaagagcaggcttcaaaataattctttgcaaaatagtgctcataaatcaggtttaagtatttttcaatttcagctggatcggttgagcacggagtgaatacacattcatcaagcaacggcacaatatacggatagatcagtgctaaggaaacagacatttttgtgaagtattgctgtgcattttgtgtcaacttctgccctttcaatactttcatgccatataacaatatcgaagcattgtctttattttcggacatcaaatccacgcaaaaatcgatgaatacttgaacttcatgatagtctacatagtcatgaaattttccaaaaggcaaaatttgtttctgaagttttcttacccattgctctgtcatggctgcgggaagcgcctcaattttggtttttttatgatttagagagagcccatactctttaagacaagcattgagatcaaccagaaattgatcggcatcatcatgcgtctttacaaagcagcagaagtcgtcgatatgtctggtgtagtcccacttcttgcaaagtgtttcatcaattttacagagaataatttctgacaaaagattggacgtatgtgggccaattaaaaggctgtgcgtttcaccatttttagagttctgcgcaaaatgatcaatttgattataccactggttcgttttagttgcattttgcttggcaatgggttttccaacaagggcccaggggatggcatgggtataaatacttgggaaacattttgaaatatccgccgacaccatgtactgcttacccatcagaagatccggctctggtgtcccgtcatccctccaattactatagttcatctgaaacaatgcatcggtgtcgtttgcttttctgatatgaatgcggctgacgatatgcttttgatttgccgtagttgtttggaaatattgctgcaaattaagccattcatctttcagacatttgcacaaacgttcatgtcccattggcgtaggaattccaagtggccgaggaatattgatattacgcatactatcatagcgtacatagtcgtgccacttatccgcaaaaacaggatgagagggatctttgcaatatgcaaggaaagaagcaccatcgaaaactggaggcagcttttccgcaaacattccgtactgaatcatccggtcatagagctcatcagcggaaatatctttcataaactcatcatatgttttaggcaccgtattgcctcctctgtgcacagtacatctgcattattgagtgcaggaatctgttattgaattgcatttaggattttaagtttcagttcttcatcgttttcataagtaccatccatgatcgccgtcatgatttcatgtagaagatccttgttgatttttccggaagctacatgatagctgatgttttcagtaatggcgaaaaagtttttcgcaacactcatgtacccgttgaataaaagaaattgtgcggacaaagtaatagcaagtcgcttattcccgtcagcaaagcaatggaattcacaggtgcaaaaaaacaaatgggtcagcttgtcaatgaatgttggataataatcatcattctgaatatgcgccagtacactttccagctttccggtatccagtggctctgtggttccacctccgctatattgtattgtctttgcgtgaatggctttggcctgatccagggtcaggtaaataataccgtccatttaatcacgctcctttaaccgacgaagtacctcctgattttcctgcatgagccgttccagttcatcaccggctgcaccaagaaacttttgatattcatcagcatccagcggctgaatatactctgacagctgatagtgaaatgcatcccgcagtgccatatcacggctagccattttgattcggccacgctgaatcagaggtttccaaagtgtcatttgctcaaattcatggaataagccctctgtttcccgaacagacaaaacccttccgatttgttctgatttcctcttgatttcttctgccagaccactttcataggcggcaatgatatccagaatctccgtataaaaagtatctctaaccttatcgttggcctttagatcaagaatttttttatattcccttgctttttctcgaaaaatactgacataaatcatgtctgtaaaatgggcgtatttgtagcgattatcttctacataatttttaagagcgtccgtaaattggcggcgataattatcttcctgcagggaggcatggacatagtctttatcccgctggttaatgtatttggtgcctccgccggttttgcgattgatcagatcaatcacaacatccagaatgacctggcggatcgcacgggctttttcactttcagaaagaagcattgcgatatctaagaatgctctgaaatcaaagactcccagcacggtcgttttggtaccgacataaatgtcggtaccaaaatgctcgtcatagcatcttaaaaaggctttcaattcccgacctctcagcagttcatagccattctgtttcagttcttctgcattggcgctgatatagcgttcgattgtacgaatgtccacttcaaaaaaagaagccaccatttctttcgtcattaaaagtcggtcttcaaaaaatacggcctctactacagaggtttcctgaatttcctgaatcgccagttcattattcaaaatgttttgacgatccaatcttgattgtgtcaaatcttttgccatctttacacctccaattcgccgctcatcagcttgggcagcaagcggtcacgggcttcttgcgccattgcgcattgtttattcagcacgaaaattttactgaaaataggttgggctacttctccaaaacggtcaatcaaatagctggcaggacacaagtaatccagtcctttcaacttatctgctttgacccgttgtctaccatcacttccactcatactgttgatggcgtaatttctaaattcatcggaacgggctatcagatataccatataaggattgattttcttgcttctcattacgatatattctgttgagccaactgccccctcttccgactctattccagacacaaaggccgtttttccgttttccaagcagggagtgattctggccaaaagggtatctccattttgaaatttggagccggagttagaatatgtctcggtgaactcagctcgattcaaaatcatggaagttgtgctgagtgcggacattggcacggattcttttaagcgatctttatccagcttgattttgggatcaaactcgatcacatcttccagagtacacaaactccacccctctggaaccccatcaacaatagtggtgttctcccaactggggaaatgcaggtctacaaaccactctttatagagccgctgggcggcttcttccagcagcttgatctgcttctggttgttttcaatcaagtcatcataggcagaaagaatgttggcaatatggcattgctcttccagagatgggatatctatttcaagttctcgaattgtcggaaggttgacatgggcaactgttgctccattagctgttccaagcaatccatattgctgttgaggtgctaataaaaaataggttaaaaaatcgggacatacaagctggggatttggcctaatcagcactgtccgttgtcccaagcaaaacttattgccatttttaataattgccgcatttccagctggtgcttcacgagcaaagattaaatcattatcttgtggagtagcccgcaaattccgctttttatatatgtcttcggacactctgtggacaccatctaaatcaaatcgtccttttcctatattcggtgttcttattagcggatatccctgtccttcatcctgagctgttgtatgaggacaatccacaataaattcacagacatcttttagttttgcaatcataaccccatctcctccatattcttggagatggtttccatcagctggttggattctgcctgcaaagaaagcagctccttgtggatttctttcatacgctctgcaaagtccacaccatcatcctcctgcggtgcaacacctacataagcaccaggggtcagggaataacccttgtcctcaatttcccaccgggatgtgatcttacacagaccgggaatgtcctggtactcgccctcgccgaacttttcatatagccacttggcctcatgcagcaccgtcagcagttcatccacctcggcggtggcggcctccacggcggcgttcagctgcttcttgaccgcaggcaggccctccagtgcaaagccgtgcttctgcttgaactgctgttgcagcaccttgtagttgctcttgctcatggacgtatagtaagcgatcacagactggacggtttcagaaacggtagatttcagcccggtcagctgctgctccagctggttcagcttttccatgggcgtttccgtctctgccttcaccgcctgtgcggccttccggatggtctccgtgtgctcgccagatagcttctgtaagaagtaatgctcgatcctgcggacgtcgtacagcccttccgtgatggcagagtgatattcacccagcagggtttgataggcctcctgctcgccccgatacagccaaacaatggcgttcatgtttcggagctgccactcgctccactcgttcagggtacggtccaccacggtgtagtaattccgggcatcaatgaacagcaccttgtcctgcaaggacttcgctttgcccttgtcaaagaaccagagggtgcagggcaggctcttggtgtagaagaagttattgcccacactgatcatcacatccacatgaccggtctgaaccaactttccccgaatgtctttgtctttgccctgactgtcggtggcagaagaggccataacgaaaccggcacggccattctcgttcaggtaatcgtaaaaataagaaatccacaggtagttggcattgccaaactccttagccttgttgatggcaggcaggccaaagggcagacggcccgcactctgggcagattctgctttcactttgtctacgttgaagggcggatttgccatcacatagtcgcagcagcccgccagattatgggcatcatgatagaaagaattggcttcatcgccggacttcaccacgccggtcagaccgtggaccgccatgttcatcagacagagcttggcgttgtactccaccttttcctgaccgtagaaggtcatggtattgttggccaccatgcctgcatggttcacgaaatcgccggtctgaacaaacataccgccacttccgcaggcagggtccagcaggatgccggaggtgggctccagaatattgacgatcatcttgaccagagatttgggcgtaaagaacactccatcgtccgatgcgatgttctttgcaaatttattgagaaaatactcatagatgcgaccgatcacatcgccgcccacatcgtccaacgcattgttgttgaagatacgaagcagttctcccagcagctcatcagagaacatggtgtactccttcggcaggacgccggagagctgctcgctctgctcctccacaagctccatggcattgttgaccacttcgcccagactacccatgacttcgccctgatggttcagcagtcccatggcggtgatgtcctccggcagattcaccagataatcatactgggcctccttgggcagaaacagcgcactcttttcggcaaagtcgctgacttctaccggcatcactctgccacggcgcatggggcgatccttcaggatctcagcctccaccttcttgaaccggctgtatgcatagcgcaggaacaacaggccaagaacaggcatacaatgctgattggaggtcagtttggaacccgcccgcagcaggtcggcagattcccacaaatcagcctctaattttttgatgttcaatgcctcactcacggcaagattcctccgtgttctttgattcatccgggacgaattccacgatatcgtcaatttcacaattcagtacccgacatattttttctaccgactccaaggaaatgtaggtgtcattccgcagacgggttgaaatattggcactgtaaccggctttcttttgcagctcggcagcagtcatattcttatcaatcaacaaatgaaataattttttataggatactgccatagttcctcctacctctacaaacgcatataagttcttgatgtttaatatatcacgaaaaagtgaaaatctcaactgttcatctatattcgacaagacccaaaaacgctttattatagaaaataagaagtaaaaggacactccgcattatcatcgaaaatttgcgatgcagagctttcctgtcctttccatcttacggaacagaaaggataggatcagtcttactaatatccgtcttattataatcagtattattaccttgtgcttttgacaactcttgaattgtcaaaagcacaattcaagaatgttcatttctgcaattcaggaattgtctttccacagaaaaactggggttactcttaaatggcgaacccggtttctcttatgcgtggagcaatgcagtaaagatagcattctcctgatgtgcgttgaatgtattccagcgctgtacccatacggtaacagttgggttgttggaaaagcattgtggcacataaaaaccaggcatcatcaagattttcatctcgatgatgcctggttcatgttttccaaccctgtcagacagatgccatatatcagtaattttcgtgggttactgttttatgaccacccatccaaccgggcggcttgcattttggagaaattacttgagctgtacgcgctcacgaatcgaatcggttacggaaagctgtacgctctgtgcggagtagccggtgcacgccacctgcgccacatagctgccgcgcttgaggctgaacgacgccgtgccgtccgtgccggtggtgatactcttgccgccgaccgtgacaaccgcaccggacagcggtgcgccgtacgcgttggtgacaaccagctgtacattctcgagaatctcgccagtcaacttgaccgtgcggcctgcagagattttgaccgtctgcgtaaccgccgcggtaaagcgcgaatgcgttgccgttacaacgtacgagccgcgcttgacataaacggttgccgtgccgtccgagccggtggtcagcgtctgcgctgccgtgccgctctccgcgtccgaaggcgtgaaggtgacggacgcgcccgaaatcggcagaccgagatcatcgaccacggaagccgtcagcgcgtaagtggtaacgtagttgacacgcagcgtcgggctttgacccttgctcatcacaaaaacgaaatccgcgtaggatgcgccgttcttgccgaattccgcaaccgcagacttgttgatcgtgaccttgctgcccttgatcttgtactgccagttctcctcgagcgtcttgccgttcgaacggatattcttgagtgctgcgccgtctaccatgttaagcgttaccaccagatcggcgtagccgccggacgaggtgttcgcgtcaaaatcgaccgtgcccggaaccacttcgttcaccggcgcggtatctaccacgctcagcgagcaggtaaaggacgaaccctgattgggtacgaatgtaaccgtataagtgcccttgctcttcttggcaagcgtctccttgagcagacggatcgtgccgttggttgcattataggtgtaatccgtgccgcgctcgagcaccgtactgccgattttgatggaatccagacgcgtgcccgccggaagaacgacgtttaccgtctgatcggcatagtttgcggactgctcgtacttatcaaaggtaatctggctcgggctgactgcgctctgcgccgagttgctgaccgccagaccgatggctgccttggagccgtcctcaaaggtcagttctgcggtgtaagtgcccgccttgagcgtggacagataggttttgtacacgcgaatgccgttcttgtcgctcagcaggttgtaatccgtgccctgcttgagattggtgccgttgaccgaaacacgggtcagatcgttcttgtccgcgttgaaggtgaattcgtaggagaacgcgatcgcgtccttgttgtttacgtcgatggacagcgtggacggagaaaccgaaacgctggtggacgccgcaacgtccttgccggcaatcttcgcggtgacgccgctcgccagctcaacgctggtcggctgcatggtcagctcacatccgttggagttgagcaccgccttctggaccgagccgccgccggtgacagtggttcttccgttcgcggtaagcgtgctgatggaggtgctgccggtcgtcaggatggtgccggtctgctcattggcaacgtcccagacagctgcatccagcgtcaggctgacgctgctgccgttcattttaagatcggagaagccgcctgcagtcgctgccagattgctctcggtcagcgttgcagaggtttttacctcggtggtgccgatgttggtattgccggtcgcaatgacctgcggggtcagtccggtcgggttggagacgaccatctcgagtgcggaaacaccgtccagcgttacattgccgccgctgacgatgatatcgcccgcaacggtgacatcctcaagcgttacattgcccgccagaacgccctcggtgatgtacagattgcccttgatatccgcatcggccagcgtgcacggtacggatatcgtaacgtttttggtatcgctcttgagcgtagcctgcgaatacacgttgccgttcttattcagcgaggtgcccatatagccgtacagcattttggcgatttcgcctcggctgagcgtgccctgcggcttaaaggtaccgttcgtgtagccgttgatataaccctgcttgaccgcttccgcaacgtaggatttgctgtaatcgctcagcttggcccgatcagagaacatatccagcgcagacaggtcagccgtcggcgtgtacttgtgcagtcggccgaggatggttgccgcctgctcacgggtcagcgtgccctccggcgccatacggttgttgccgacaccgttgatataaccctgcttgaccgcaatctgcacggtttcgtagaaaacatcgctcgaattgacatccgagaagctgatatccgccttttcggtaaagccgaacgcgcggttgatatagcgcatgaactcccagcgcgttaccttgtcatccgggccgtagttgcccgtgctggcagacggattgataatgccgttttcatgcagctcggtaatgtaggactttgcccagtggccatcaatatccgaagccgcaaaggcagccggcacggtactgaccagcagcgccgctgtcagtacggcggaaaggacttttttcaaagctatcacctcttattataatttacctttattctaccattcttttgtttatttgtgtactgttatttttatctcgagacagggcttttgtctaaatagacggcctgctgccggttttggtttcgcattttcgcagaattttccggtattctcacagaacgtacaatttctgctctgccgttttgtatatcattactccgcttcatggaatcttttcacaaattcgcgcaaaaccccttgcattgacagccggatattgtataatttagatagtggcaatccgtcggttgaaagcggcgatgcgccaactaacacgatgaggtgataccaatggattatatgtcggaatacaagcgttggctggactgctctgccctctctgcggacgagcatgccgagctggctgctgttgcagataatcaggaagagatcgaaagccgtttctttgcgccgctgtcgttcggcacggccggtctgcgcggtgtactgggcgtcggcctcaaccgcatgaaccgctttaccgtcggtcaggctgcacagggtctggcaaacctgatcgtatcgaacggtcaggccgcaatggaccgcggcgttgccatcgcatatgactcccgccatttctcggccgagttcgccaagcagtctgcgtgcatcatggccgcaaacggcatccagtcgctgctgttcgatgagctgcgtccgaccccggagctgtccttcgctgtccgtcactacggctgcatcgcaggcatcaacatcacggcttcccacaacccgaaggagtacaacggctacaaggtttactgggaggacggcgcacagcttcctccggccgaggcagacgtggttgccagcgaaatggcaaagaccgatatcttcaccggtgtaaaaactgcagactacgatgagtccgtcaaaaacggtctgatccgtattctgtctaaggagaccgacgaggcttacctcggcgaagtcattaaggttgcggtaaatccggactgcgtaaagcaggttgccgatgagttcaagctagtgtacacgccgttccacggtgccggctaccgtctggtgcccgagatcctgcgccgtctgggctacaagcacattatctgtgagccggagcagatgaagatcgacggcgacttcccgaccgttaaaaacccgaatccggagtacaaggaaggctttacgctcgccatcgagctggcaaagcagaacgatgttgatctgatcatcggcaccgacccggactccgaccgtaccggcatcgtcctcaaggacaagtccggcgagtatgtcaccctgtccggcaatcaggtcggcgtgctgctcaccgattacatcatcaccgcaaagaagctgacgaacaccatgcctgcccatccggcggtgctcaaatccatcgttaccaccgaaatggcacgcgcggcggctgaaaagaacggcgttgagtgcttcgacaccttcaccggcttcaagttccttgccgagaagatcaagcagttcgagcaggacggctcgcacgagtacattttcgcattcgaggagtcctacggctacctgtgcggtgattatgcccgcgacaaggatgccgttaccgcttccatgctgatcgccgagatggcggcttactaccgcacccagggcaagaccctgtacgacgcaatggaagagatgtacgaaaagtacggctgctactgcgagcagaccatttcgatcgttatgccgggcgtttccggcctgcagcgcatgaaggagctcatgcaggaactgcgcgacaagccgctgacccagatcggcacccacaagatcgattacacccgcgactacatgccgggcacccgtacctgcatggcagacggcaagtccgagccgatggagcttaagggtcagaacgtgatgtactacgagctcgagggcggcacaacctttatcatccgtccgtccggcaccgagccgaaggtcaaggtttacatcatggccaagggcgagaacaaggccgaggccgcagaaaaggtcgaggctctgaccgctgcagcgaaggaaatcgtaaagtaactgaggcaacaccgcagtaaaaatccagcaacgctgaatgcagccgaattccggttcggctgcatttttccggaatcaccttgattaccgaaattattacgccttaattattttaggggaacaaaaatatgatcaaacgcattatttcctgtattgtaagcacggtcatcgtgctcggtgccaccatcgcgtatgaccgcacgcctgcatgccgcattgccgtgatggagcaggtgccgacacagctggcttccgttctgccgcgtgctgcctcctacgaactggagctgcgcacggaggaaggcaaccgcagctacacggtcaactgccatgacaaggacggcagcaccttccggtcctacaccatgcagaccgtggaaggtcaggaggagccgctcaacttcacctacacagactacacctacgacgaaaacggcaactgcacggatgctatcaccaccgacaagaccaacaactccacttcggaataccgccgcagctatgacgacaaaaaccgcgttctgcgcacggaaaactatgaggacggcgaactttcggcctcctctgagacggtttacaccgaggttgacaacggtcagtcctctgccgtcaacacggtttacgacgcagacggcaacgagctgatggtcgtccgcatgggcatgaacaccaacggcgacgtgctgtcctcccgcacctacgagggcgaggacaatatcacctcctccaccgacaaccgctacgacagtcagggacggctcatccagtcggtcaccgtagacgagagcggcgtcgtgttcgaggtgctcaccgtgtactcggtggacggcaaaacgcagaccacccgctcgaccatcgaaggcggcaccctctcgaccgatacccgtacctttgatgataacggcaatctggtctccatgcaccagaccgacagcgacggctacacaagcgataccacttatacacagtttaagtgacctgtcgcggaactttaatccgcagtgaaaaccacccgttcgggtggtttttcctttttttcgggcatactattatcagctatacaccgaccatttctccctatttgtcggttttccgctaaactcctgcaaaattcctgtctggatattgctttttctcggtcaaacagctataatcgctatatgcgtatcaagactgtgtcaacagagcacagctatagagaaatagatcggaggtgcgctatgcgcatcattattgtaggctgcggcaaagtcggctcggagctggcaggacagctcagcgcggccggacacgacctgacactgattgacctgtccgaacgccgtctggatgaactgtccaacacacacgaccttgctacagtaaagggcagcggcaccagctatcacgttctgcgtgaagccggcgtgcaggataccgacttgctcatcgccgttaccgcccatgacgaaatcaatctgctttcctgtctgatcgcccgcaaggcatccggctgccacgccattgcgcgtgtgcgcgatccggaatatgtatccgacctcggctttatccgcgatgagctgggtatttcgatggtcatcaaccccgagctgtccaccgcgcgtgttgtttcgcgtctgatccgcttcccgtcggccatccgcgtcagcacgtttgcccgcggacgcatcgagctgctcgacctcaaaatcccgcacgagtcccgcctggacggtatggcggtctgcgaggtcaatccgctgctccgcacggacgtgctgctgtgtatggtccgccgcgacggtcagacctatattcccaagggcgacttcatcctgcgcgaaaacgacaacatcacggttatcattccgccgcacgagcagagcgaatttttcgagaaggtcggtttgccggtcaagcgcatttcctctgcgatgctggtcggcggcggcaaaatctcgtactttcttgcgaaaatcctgctgaattccggcattgcagtcaagattatcgaaaacaaactcgaacgctgcgaagcactgtccgaaatgctcccgcacgcgaccatcatctacggcgacggcaccgaccgcaacctgctcgatgaggagggtctggcaacctgtgaggccttcgcggctctcaccggcatggacgaggagaacatcctgcttgcgctgcacgccggccgtcattcccgtgcgaagctgttcaccaaggtcaaccgtgtgaacttcgaggaagtcattgccagcatgccgatcggcaaggtgattcgccccaagcagaccaccgccgagctgatcagccagtacacccgcgcgatgcagaactcgatgggctccaacgtggagaccctgcatcagctggacggcgcagaagcgcttgagttccgtgttgcggcgcaccatctcaccggtgttcccctgcagtatatgccgattcgtccggatgttctgctatgctgcatcaaccgcagaggcaagcgtatcattccgcgcggccacgatgtgctgcatgaaggcgatacggttatcgtcgtttccaccttcgagggcatgaacgaccttcaggatatcttcctgccgacagccggagggcgcgaaaaatgaatttcgcaatcgttcgctatctgatcggctggctgatgggcattgagtccctgttcctgctgctgcccgcatttaccgcggtcatttaccgtgaacccgagctgcctgcctatatcgccaccgcactgatttgtatggtcggcgcaggcattctgtgtgaatacaagccgaaaaacaccaagttctacgcacgcgaaggctttgtggcagtcgcgctgtgctggctggtgctggccgtgaccggtgccctgccgttcgtgctcagccgcgagattccgttcgcagtagatgcgattttcgaggccgcatccggcttcaccaccaccggcgctaccattctcggcgatgtggaggcgctttcgcatgcctctatgctatggcgctgcctgatgcactgggtcggcggcatgggcattctggtgttcatgctgatcgtcctgccgctggcaggcggtcagaccatttatctgatgcgcgcggaaagcccgggaccctcggtctccaaaatatcgccgcatatgcgcgataccgcgcttatcctgtacgcgatttactttggactgaccgttctgcagattattctgctgctgttcggcggcatgccgatgttcgacgccatctgcgtttcgctcggcacggcaggcaccggcggcttcggcaactggaataattccatcgcgcattacaacagcgcctacctgcagaatgttatttcggtctttatgatccttttcggcatcaatttcaacgcgtattttctgcttttgacccgtaaattcaagcaattgttcaaaatcgaggagattcgcgtgtacctcggcgtgattgccgtatttaccacgctgatcgccttcaacgtgcgcggctgcttcggttcgctgcgcgagagcttccaccattccctgtttcaggttgcgtctatcatcacgaccaccggtttttcaaccgtggactttaaccagtggcctgcattcagcaagctgctgcttgtgctgctgatgttcatcggcgcgtgtgccggttcgaccggcggcggcatgaaatgctcgcgcatcctgctgctgttcaagggcgtaaagaaggaaatgatgtcgctgattcatccgcgtctggtgcgcgtgcataaaatggacggacagcgcgtccagcatgaggtcatgcgctcggtcaacgcctttcttgtggcatatctgatcgtcattgccacttccatcctcattgtcagcctgcactgtgaggatatgataaccagcttcacctcggtcgttacctgcatcaataacgtcggtccgggactcaatcaggtcggtcctgcagccaacttcggtgcactgcacccgctgagtaaaatcgtgctgactttcgatatgctcgccggtcgtctggagctgttccccatgcttctgctgtttgcaccggaaacgtggcgaagaaaccgataaaaaaactgccgctaaatgtataccgtttagcggcttttgcgatgtcgaacgaccacgaatcgttccggtgctccaccgacacacccgaatcatcgcggcagaatatgtcgagatggggttttccggttgctcatgggtatctatctctttgggtaacacgatggtgctttttctttctgacaatagcctgccacgggatctatcggttgacaaatacgttttatccgcagcccttcacagttttaatctatcgacagatgctttttcagtgccttcacataggagtccgcatagcggctgaataccacgtttttcttgcggatgagaccgatgcgcatgctgccttccatctcgagcggccgcgcgataatgctcggactgttcagcttgcggtcgataatgcccgagctgaccgtaaagccgttcagtccgatcaccagactgaacagtgttgcgcggtcgcggacctgaatggttttcggcatgtcgagcatgctgagcagttcctcggaaaaataaaaggaattgcggtctccctgctcaaaaatcagatacggatagggtctcagttcatcgagcgtgatgcacttccggtctgcgagcggatggtccttattgatgaacacatgcggtgcggcagtgaacagttcctcgaacacgagctcacttttgcgcagcagcttggagagcacggtttcgttgctctcggacaaatacagcagacccagctcgcttttgcccgacgccacatcatcaatgatctcgccggtctgcgtttcccgcaggataaaaccgtactggtccgcgtcgtactccttgacaacctcgacgaatgcgttcaccgcgaacgaatagtgctgacatgacacgcaaaacttgggcacgcgctttttgcccacgccgaagtgctcctgcatgatgtctgcctgctcgagcagcatgcgcgcaaacgaaagcagttcctcgccctcctgcgtaacggttacgcccttgtttgagcgcacaaaggcggtaacgcccatctccttctctaaattgtgaatcgcggcgctcaaactcggctgcgagagaaacagccgctcggcggcgtccgtgatgttgccgcattcggccacagtgacaagataggtcagctgctgcagagtcataggaaaaacctccgggaaataatctgtatctattgtagcatgtctgtgcggaaatacaatgcggtttctttatctattcccgcaatttcatgctatgatagagacaaaggagagcgtaaaaatgaaaaatgtactgttttacggcgattccaacacctggggttatcagggcgacaatcccatgcaccgtctggacgcggacaagcgttacaccggtgtggttgcggctcagttcccggacgtgcactttatcgaggaaggtctgtgcggacgcaccatctgcagcactgacccgattgattacggccgaaacggcatgtcaatgctgcctgccctgctggcaacgcacgatccgctcgacgtgatcgttatcatgctcggcacaaacgacagcaaggcaatgtacggccactcgccgttcaccatcagcgatgccatggaccgcacgatcaagctgatgcaaagtccgcttttatggtcaaataccatgcagaaaccgcagatccttctggttgcaccgccgaaaatgggcgaaaaccttgcagacagcgtctactacggcatgtttgacgaaagcagtgccgcactcatccgtgctctgcccgcacggttccgcacgctggcagaaaagtacggctgcgccttcgtggacggctcggctgtcacggcggcaaagtgctcggaccagattcatctgaccgcagaggagcacgccgtgctcggcaggctcattgcgaacaagctgcgcaagctgctttaaccccctgcccgaaatcatttatcatctttttccctgccttgataccgcaaacgcggtaaaatacaggcacaattcgttttggcggaatgcagggcgccagccatggcagccgccacagcgcacaagcggaaaacaagcgcatgcaccttttcccccggttttgtcaggtgacaaaaccggggtgttttttgccgcattttatccacagcctgttgataattcctgtggattgcgtgtcattttttgcagaatttacgcgtagttcactctgtttttcctatcggtgtatttcgtgtcgaaaatcggacatttcgtgtgcccgaccgcacagcaggctgcaaagctgctatgataagcgcaggcaattttcagtctcttttctgcaggcgcggctcgttccaccgcaccgcagaataggaaaaggaggaatataccatgaaattcaaacgcggcataagccttgctctggcactggctcttatcgccggcataggcggcccgcttgatatccgcgcagcggcggcggataccggcagctcggacgcgcttgcggcgctcggtattgattcgagcaaagcgcccgacggctttaatgccaacgaccccagcaacccatacgggcgcaataccatcaaggttacgccggtgtacgagctgtataccgttggtctgacgagtgatgttctgccatcggataaaatcgatctggacaagcgtgaaagcgcagagaaatgcgatacaagcgtttccaagtccaaccagaaggacaatacccttcaaagcacgctgtacggcaatgatgataacgcatctaccaaggctcagcagtttttgagcgctcagaagcagaaccaaactatttctgagggtaaaaccacctctaccggcacatacgcacagttcccgacaggcagcaagggcagtgacggctatgccaccaagggctatctgaccagcatgaccaatgcgtctaccaagctgaacgacaataccaattacgccatggcagacgtagccgcaggccatttcacctcgaacaaggacgccaagtcctcgcagacggtcatggtttacgccggtgacctgagcgcgaaaggcggtctgtacctgcgattcggcgatgctgaatccggcaagtacggcacgccgatcacgctgctggacaccagcaaggaaatcggcaacccgaatctgaccgacaccagcgatgaaggcagcacgaccgccaaaaaggtcgaaaacttcgcagaaaacccgtatcagctgaaaaactacctgcaggtagctaccggcgactgggacaacgacggtaaggacgaggttgcggtctatgtgccggaggtcggcaattcccgcattgagatttacgacctgcagactgaagattactccaatccctctaactggagacaggcgtggacgtacttcttccgtgagggcagtgtcgtttccaacatgatctctctcgtcagcggtgacgtcaaccaggacggcgtagacgatctcgcctgcacctggggttactactacggtccgcagcagaacgcaggctcgcgtgccgttgtaatgttcggttccacgagcgcgcacatgctgcagagctcgcaggaattcccgctgacctacgagggcagcaatctggtccgcgcatccttcgccttcggcgatatgaccggcggcggcaaaacgctgattctggcggctcagtcggatgctgacctcaaggcaaataagcagaatacacgctatgtaggtttgtacgcatggaacggcgtcaccttccagccgtctgtttcgcagaatttcgatctgttctccaagaacgataaaggcgagtacatctacggtgcaatggcaaagcacaacgataccttccattctctgccgctgtgcccggccaatacggcgattatctcccgtccgaccgcaggcgaaacaaacgatggcggcaaaacaagcgatctgctgtactttgacagccttgttatctcctgcgatgagaatggtctgaatatcaagcaggcgcttgacaacacggccgctatgccgagtgaggactacgttgagtacgatgcatccgcaggctctgtgaccaccgcggtggataaagacaacaacaccgcaggttcgggtacgctgttcaccctgacacagaccatgtccaaggacacggagcataagtccgattcttacaccgtcaagggtcaggttccgaagtacgagcgccgtgcctactacaagagctggtggcacaagctgttccgcagaaagtcctactaccaggcttttgtcggctacgaaaccgtagatcaggcggttcagacaccgtacaccacccgcacgccgggtacgaccagactttcgaccgtcaacctgtttgacggctctcagccggtaaaaaccgatgtcaacagctcgtacacgctctgtctcgccaacacggacgacgataccagctacatgacctacaccggcaagcactattacacctactccgacccgcaggttctggcggtactggcttcacctccgtacttctccgatctgctcgaccgtgatgacctgtccggcaactatgccgagtcctccaccacctactcgagcatgaagggcaccgaaaacggcaccagctcctcctctaccatctcggtcggcgcatacgtctcctttgagcaggaattctcggtattcggcgttaagatcggcagcgttgaggcggaagccgcctttacctccggtttcacctacgagaccgagcacacctcctcgctcgagcagtccatcacctacgagacaacctccggcgaggacagagtggcgttctattccatcccgatggagatttacgagtacacctcctacatcccggatggaacaggcaaatacacggaagtaacctccaccgtttccatcccgcacgaagcctcgatcggtctgatcgacctgtccgactacgaaaacattgccgaagattacagcgttctgccatccatttcgggcagcgtgctgacgcatacgatcggtgatccgtccagctatccgaccaaggaatatgcaggttccaaggcttatgaaggcaagccggctaaggttgacttcaccgcggcaggcggcggctccggcatcacgcaggaaatcagcttctccacctcggacagcaaaaactacaccaacaccacctctatcgaaaccaaagccggtgcaggcgcaggcggcgtaaccgcaggcgttgtggcaggttcggaacactctgccggcaaggtatcggtcaacaccgcaggcggctcgttctccggttcgctgcagaacatgccgatcgaagcaaaaccatacggctacggcatgaactggcgtattttctgctacaactaccgcagcggcaatcaggcgttcccggttgttacctacgcggtaaccgagccgcaggctccgtctccgctgccggacgattttgagcaggatgttgcggcaaccaccaatgattccgtcaccctgacgtggacgtacgacaagatcgtttccggtttccagctgtaccgctactacaacttcccggacggctccggacgcaaggaactcgcatttgtgccgttcaccgatggtgagcgtcacgatgacggcacctacaccttcagctacacggataagaacctgtctccctataccgagtatgagtatcagattcagacccgcaacaacaacaaggctgagcagcagcgcaacagcatttacagcgaaccgctgacctgccgcaccaagaccacagcaggctatcccgatatttcggtaacgattgacggcaaggagaagcagacggttctgccgatctatccggattctctggcaaccgcaacggttaagtataacggagacaataaaaatccggacggcggcaagtacaacagcgtaagctatcagtggcagaagctgaacaatggttcctggaccgagattgccggcagcgtttccgatacgctaagcatcgaaaacgccggttctgccgacaagggaacttaccgctgccgtctgaatgtgctttactacgataacacctccaagaccgagtacagcatttccgcttactcgcctgagattaccacacagtacagcaagcgcacgcccaagtgtgagctgaatgttacggcagagaatgtacaaaaagacaacactgctcagtttgaccgcacgctgcacatcaatgctaaaatgagttccgcgtctgctacctccaccatcccgaccggcacgctcagcttcctgattcgcggcacggacttctctaccacggttgccgcagagattggcgccaatggcgtggccaccaaggacgttgtcgtgcccgcagacggtgcttacacggttaccccgtattatccgggcagctatgtattcaaggatatgagcaacgcggaaggccagatggttctcgttggcgagaacgcgaccggctatcagctgacgctcaccaacggcaataataacaacagcgtcacccgcttcacctacggcgatacggtaacgccgtcgctctcccgcatgagtaaagatacgcatggtctgcagaaggtcaataacgcgaccttcaagtatgcagtttccggttcgaaaacacagcaggatttgaccaatccgctgaatgtcggcacttatacgctgtatgcttatgtaaacggcgaaaccaagccggttgcggaaactaagtttaccgttgttcagcgtgccgttacgctgcgtgttgttactccgaaggacggcgttgcacaggataaggttaatcctaccgactcgaaacagctttctctcgcggcagacacgaaaaacatgactgctgatgagattgatgctctgcaccttgactataccgcagtcaacaccgcaggcaatacggtaccgctcgcgccgaacattgcgcccagcaactacacggtttctccgtgcacgaccgctaaaaccagcaaaacgttgtacaacaactatgaattcacctttatccccggtgtttacacggtaaacggcctgacttacatcctgaccctcaaggctgaggacttcggtgaaggcgcaaacaagcactctgtcggttctgcgtcgatcattactgcaggtctgaacgccggcaaggcggatgacggcagtacaatctccagcttcactgccaacaccgatgttactctgacggctgtgccggatgcaggttatgctgtcgattactggacctatgacggcaaggaaatcgaggacagcaaggagaagagctcggttaccatcaagacccttgcaaaaccggcatctgttttggtttacttcaagaccaccaataccaaactgaatgcttccgttcagaataagcagggcggtacactcaaatgcacggatgaagatggctccgaaagcctcaagaacttcccggcttacattgccagcggtgcaaagttcaacttcaccgcaacgccgaacaccggctggcacttcaagcagtggattctcacgaaacgcggtgcaaacagttatccgtccggcaccccgcacgataacggctccaacacgctctctgttgaggttggcgtgcaggatattgatctggctgccgtatttgagcgcgacagctacacgctgacgctggaaggtgaactgaccgcaagctatcagacggttgatccgaacgatacctccaagacgctcaccaagcctctcaagagcggcgaaagcgttaccggcgatacaaagattacggtagcgcccaaggcaggctatgctgccgccacgggcgagacctatcaggtgaacggcaaggctgttgaagcaggaaagctcaacgctgacggcagctataccttccccatcactgagaataccaaggtttcgctcaagaccgaccgtgccgcatttgcgattacaacaccggaaatggagcatggcacaatcattgcaaccgtagacggcgaagctgtggacgatctggccaagattcccggcggcagcaaggttgtgctgcaggcacgcgcagaccgcggctggcatttcaagaactgggttgtaaacggtactgctcagaatgaagctgcggcaaagaccaacggcacttacaccatcagcgaactggccggcgatctgtccatccacgccgaatttgcccagagcgcttcctacaccgccaaggccaccgctgcagctggcaacggcaccgtaaaatacacgctgtatgatatctacggtaaggaagttgagaccaaggctataccgactgatggcgtaaccatctataaggatgaggaaatcaccttccatgcagcgccgaagactggctatcaggttgaacagtgggaagtaaacggcaaaaagactgccggaaactccaaaaccaatccggaaggcaaaatccgtgcggacaagaatattactgcgaccgtatactttaaggttacggcaagctatcagcttactttcggcaccactgatgcgaacggccatctgaccgccaagattgacgacaccgcgattaactctcagaccaagcagccaaacggcagtgtaatcaccttcactgcagcaccaaacacccaaaagatggttgaaaagtggacggttacccagggtgacattaccgcagcagaaaacgatgctgctgtacaggttaatggtgtaaatcttgtcgatccaatttatattcacacactcgatgacaaccagaccatccgcgttcacttcaccgaccttgtacagtacgatgccaagatttccggcacgaacggcaccggcaaattcacctacaccacgccgattcagccgaacgacaccggtgcagtcaacagcgcatccgctcaggttcgcaagaacggcacggtcaagctgacgctcgcaccgagcgcaaactgtgtcggcaccgccgaggaaatcaagtccgaactccagaaggcagctccgaatgccgttgtttccgtaaccgagaaggacggcagctttgaagccgttatccgcaacgtaacggaagctctggcggtcaacaccgacaatctgttccacaaaacttacgcaattacggccggcaaggccgaaaacggcagcgtttccgcttctgcggcacgcgccaaggctggcgacaaggtaacgctcaccgctgcacccgcaagcggctatcagctgaaaaccctgacgctgacaccggagaccgcactcgacaaggcggtttccgcgtccaccctgacctacaccttcaccatgccggcgaatgacgttgcagttaccgcagcctttgccgtcaagccgagcagcggcggcggcgcaggcggcggcggtggcgcaggcggcactgttgcaccggctccgaccgacagcggctcgtcctccattaccgcgccggacggcaccaaggttcccgcaacggttgaggtaaagaacggcaccgcagcggtttccgccgacaactccaagctgactgcagtttccggcgaggattcgctgacgcttgacctgtccgcagattccaccgtacgcacggtatcgctcaccggcgatgtggtagctgctctcgccggtgcaaagaacggcgcagcgcttaccctgccgaacggcacggttgcactcgaccgtgagacgctgaccgcactcggcagcgccgcacaggccgatggtatggcaagtatttcgatcgcttccgctgacaagtcctccctgacggacgcacagcgcaaatatctgccgaagaacggcaccattctgaacatttctgcgcaggtgcagccgaaaaacggcactgcaacccgcattcatgcgctgaacggcacggcttcggtttctgtagcatacagcctcaagagcggcgagaacgccgcgcatctggttgcatactatcttgctgaggacggctcgttcgaaaagctgcctgtcatttatgatgcagcgaccagaaaggctacctttaagaccacccacttctccaccttcgttatcacccacgagtacagcagcgacttctccgatgtcaatctgcgcaagtggttctacaacgaggtcaacactgcactcgagaacggctggttcaagggcctgaccgcaaccaagttcggtccggatgacggcatgacccgcgcaatgctggttcaggtgctctaccgcatgagcggcagcaaggccgcttccaccgcacagttcaccgatgtggcggacggcaagtggtacgcagaagccatcgcatgggcctccgaaaacggcattgtcaacggcttcaccgacggcagattccagccggatacgctgatcacccgtcagcagctggcggccatcctgtaccgctacgatacctatcgcggtcatacgccgcagggcagcgcagcactcgatggctacgcagacgcggcttctgtcgagtcgtgggctgctgaggcaatgagctgggcgaacggcaacggtctggtaaccggcgttaccccgactacgctcgtgccgaacggcaccgcaacccgtgctcaggtagcggttatcctcagccgctacaccggccagtaatctcatccgatccataccacccaacggatatggtatgaacaaccgccctgcaagggcagacaataccgacagcgcctgaaaacgcacacaagcgacaccaatcgaaatatggtgtcgcttgtttttttgcttctcacacggaatacgctcacgcgagaacgaatcgaacagccgcggcagaaattccatgctcatatgtcagcttctccggcgtgatatactctgccaaccgaatcgcaagtattttcaggctcgcggctcattatatcgtacaccatgttctatatttgcataatactgtgcaaatttgacttattttgatttacaacgtcgttgcagggtgatatactgaaattaccatataagatgcgccggattatgctttgaggagaatgctataatgaccatgaatgacccgctgctccgcacggacagctatgcaaaaatcttcctgtataacacccatgaaaccgtcgcctgtgtgccgcgccacaccatccgcatgcgcgataaagtgcgcccggacaagctgcgcgaagccgtcgagcaggcactgctgcgctttccgcacatgatgctgaccgccgagccgaccgagactgcgttccgctaccgccgcaacgtgcagcccgccgtagtgctgccgttcgacggtgtatccacccgctacaccatcggctccaaggatacgaacggatacttatttctcgtcggctaccacgacaagaccatctatatggagtatcagcactctatctcggatggacgcggattcgaggagtttatccgctgtgtactgttccagtacctgaaaaactgcggtttcccggttgagaatgacggctctgtgcgcggcatggatacccgctggtctcctgaggagagcgcaaacggctacgagcagctggcagaccgtgaattttcgccggatggcatctggaaaaagccggaggctgttcatgcccccgaggtacagtggggcgctgacggctccgaggtcgtcaccgaggtgacgttcccgttttctcagctgcacgattacgcaaagtccatcggcgtcagtccgctgtctgtactggctccgctgatgatgaaagcgtttgatgataagttcggcggaacggacaagccggttatcgcggagattccggtcgatctgcgtccgctgctgccgacgcttaccacgcggtattttatttgctttatcgatctgccgtattttccggaataccgcgatctgccgaatgacgaggtgttccggcgcacgaaggcgtttttgaaggatcagatgcagcgcgaacagctgctctatcgtgcaaaagccgccgcagaccgctgtgaatcgctgcatgaggcagatatgccgctcgcagagaaaatgcaggcggcacagaaggtcacgactgattttgtgcttgaggacagctttctcattaccaatgtcggccggttcgccctgccggaaagctgccgtccgtatgtactcgattacggcgcaatcctgccgtgtgctgtgcagccgtttgcgctgctgatctcgtcgtatggagataaaatgaaactgtccgttgcgcagcgcgaccacgatatgcaggttgtcgaggatttgtgcgccggtctgcggcagcttggcatccagcctgaaacactcagctatccgtttgtagtgacacggtataacggacttgagtgcgggatgtaagttcaaaactgtaatttcaaaagcaaaacgctcagctaccaaacgatagctgagcgtttcgctttctttatccaagccgcgcgaccgtgtagccgacatacagaccggcaccggtcacaagtgcattctcgtccacatcgaagccgccgttgtggttggtgatcatcgtgtgcggcaaatccggattgccggtgccgagatacgcatacgcgcccggcttatacagctcaaactcggcaaaattatcgccgctgagcgacagctcacggtctgtgacaacgtgtccttctccgagcagctcgtccacgacccgagcagcttcctcgcacacctgcgggtcattgacgagcgcagcggcaaagtccgtccactcgacttccgccgtgccgccgtacagcgccgcaatgctctgcgcggtctcactgacctgtgcacggacgcggtcgcggctctcctgcgaaatggtgcgcgttgtgccctccatttcagcaaatgctgccacggcgttgtaggtcgtgcctgcattcagcttgccgataccgatgatgaccggctcggtcggtgaagtgcggcgcgtaaccagtccctgcactgccacgacaatctggctggcgatgtacagcgcatctacgcccagatgcggcgtggaaacatgcgtggacttaccgtacacgcgaatgcggaaatgatcgactgcggcattgttgatgcccggtttgagtcctaccgtacctgcctccaaatcatacgcggtgtgcagaccgaacacgcgctcggcaccatccagcacaccggctgcgacaaacggctttgcaccttttccgatttcctctcccggctgaaacacaagacggacctttccgctgaacgcgtctctgttctccgacaggattttcgcggcacccagaaggcaggcagcgtgcgcatcatggccgcaggcgtgcataacgcctgcattctccgagcgatagacgcactcgtgcgtctcctcaatgggcagcgcgtcgatatccgcacgcagaaccagcacttttccgttgtcctttgcgcccttcagcgtgccgagcacgccggtttcgcctacgcgcgtgtgcggaatgccgaacttgtccagttcctcctcaatgcgctgtgccgtgcggaattcctgcaggctcagctctgggtgccggtgaaattcccgacggatggatacgatgtagtccttcgtttccactgcggctttctttacatccatggcggcttttcctcctgtttatcggtgtttcggtttgatcttatcacgcagaccttccagacggttgagtgcatcgagcagcgtctcgtccttcttggcaaaatgcaggcgaatcaggttgttgaccggctcacggaagaagctcgatccgggaaccgcgcctacgccgacataatgcgccagatcctcgcagaacgcaagatcgctctcgtagccgaactcggcaatgtcgagcagaacatagtacgcgccctgcgggtcggtatgggcgattttgagatcgtccagacctttcaggaacagatcctttttgtgcgtgtacttggcctgcagatcgtcgtagtagtcctgaccgaacttcagaccggtaacaacagcctcctgcagcggtgctgccgcgccgaccgtcaggaaatcatgcacctttttcgcgcggtcgatgatctccggcggagcgatgatgtagcccagtctccagccggtaaccgagtacgtcttggagagcgacgagcacgacagcgtgcgctcccacatgcccggcagggtggcgaaataggtgtgcttgttcggcgcgaatacgatgtgctcatacacctcgtcggtgataacgtaggtatcgtacttctccgcgagagacgcgataatctccagctcctcgcgggtgaacaccttgccgcacggattggacgggttgcacaggatgatggccttcgggtgctgacggaatgcatcctcgagcacgttcgcatcaaagtggaaatccggcggcacgagcggcacataaatcggctctgcgccggacaggatggtatccgcaccgtagttctcgtaaaacggggagaaaatgataaccttgtcgcccggattggtgactgtcatcatcgcagccatcatggcctccgtgctgccgcaggtggtgacgatttcggtgttcggatcgatcctgcgacccatgaaatacgtctgcttggcggccagcgcctcacggaagttctgcgaaccccaggtaatggaatactggtggtaatcctcgtaggccacctgcgccagacggtcgagcagctccttcggcggctcaaagtccgggaaaccctgcgacaggtttaccgcgtcatactgcatggaaacgcgcatcatgcggcggatgaccgagtcggtaaagccggcggtgcgttcggataagctctgcatggttattttcctcccataatgtaagatttctgatcgttaagcgtgtgcttcgggtcgagagcggtcttgatcgtgttcatcacggcaagattctcctgcgcggtctcccgcaggaagtacgaccgcttggaaatgccgatgccgtgctcacccgaggctacgccgccgtaggaatacgccttggcgtaggcctgctccatgttgtcgtgcagttcacgctcccacgtctgctgatcacggccgtcacgcaccacgcacagatgcacgttgccgtcacccgcatgaccgaacgcgatcatacgcacgcctgaggatgcttccagctcgttgatgtagcgaacgaaatccgccgtgtggctgatcggcacgacaatgtccaccggctcctgctcggacacagcctcgaccgccatgacgagcgcaccgcgcaccttccagatgtcggcagcctgctcagcgctgcgcagcacgatatagtcgatcgcaccgttgtcaagtgcaaggcggcgcacgcgctcgatattcgcgttgacctcgctctcgtgaccgtcaaacgtcagcaggatgtatgaaccggcatccgggcgcggatactgcaccttgcagaactcctcgccgagcgcgaccaccttgcgttccatgaactcgactgcggtcgggttggcgttcgcctgcaggatggtcagcacgctgcggatacccgtgccgaggtcggcaaacggcacgagcacgctcaccgtggtctccggcttgggaagaaggcgcagcaggcacttggtaatgaccgccagcgtgccctccgagccgatgagcagatgcttgagcgacagtccgctcgcgtccttcacctgcttgccgccgacttgcagcaccgtgccgtccgcaagaacgacctccagtccgcgcacataatcgcgtgttacgccgtacttgaccgcacgcatgccgcccgcattggtgctgatgttgccgccgatgctcgaggccttttcgcccgggtcaggcgggtaaaacagaccgtgctcctcaacataggcctgcagatctttgagcagcatgcccggctcgacggtgaccgtcatcgtgtcgcggtccagctcgagcacgcggttcatgcgggatacatccagaatgataccaccgaacagcggaattgtcgagcctaccagattggtgcccgcgccgcgcggcgtgaccgggatggcgttttcgttggcgtaccggagcacgccgctgacctcctcggtcgagcgcgcgaacacgagcgcgtctgccgtgccggtgcggcggccgagcgcatcgctcaggtattccgccggaatattttctgcgaaaagcagacggtcttcatccgaaatgatattctgcaaagcctgtttgcttacttccattgctgtttcctcctgccaattcctgtcgcgaaactacagtttcgccgacaagaggaacggaccgtgggccgttccaaagtcgtccgaaagttcctatacagaaactttctccctcttaaagtataaaaacggtgatacatgctccccgtttttatgaatttgtttcacaaattctatcaaatgcgcgcttacgcgcgaaaaacccaatccgatataacactgcatttgatagattgaatgccgccggtgctttccggcggcattaggaatcactgtgagttacttgtcagccagcagatcctgatcccagcctgccttgatgaagtagccgccgaactggtcgttgaataccttctcggtctcatcggactggaatgctgcaacaaccttcttgtaggtctccagcttgtccgcatcctcaaggtcagcggaacgcgctgcgatcaggttccagtactcctcgatgtccagctggtcatccttgtagatggcgtcctcagtcttaaggccgaaatccagtgcgtagttgccgtttacaacagctgcggtaacgtcagccagcgtggacgggattacgttagccttcagctcctcgatggtgatcttggtattgtaggtctcgatgtcgtcgatagtcgggttgaactctgcgctgtccttcagcttgatcaggcccgctgcttccagaaccttgagggcacggccgccgttggttacatcgtccggaatggctacggtgtcgccatccttaagctcatcaaccgacttaaccttgtcggagtacaggttcagcgggatgataaaggtgttgccgatattctcgatctcgtagccgtagttgtcgatctcgctctgcaggtaaatacggtgctggaaagcgttcagatcgatctcgccgttagcgagtgcgttgttcggggtaacgtagtccgagaactgtacgaactcaaggtcgatgccctcgtcagccagcttttccttggccgaggtccacagatcctcgtagatgctgccgactacgccgagctttacggttacggcatcgccggaattgctgtcggatacctgtgcattatcggaagctgcgctgctcgagccgccgcaggcggtcagggacagggcgagggttgctgcggacagggacagtgtgatgattcttttgagcttcattgggattacctccgtttatgatgtgaactttttaattaactgatgttagagagtgagcgacagctgataattctcgctcatggtcttgcaggatgcgttgaacttctcctgctcctccggggtgaggtgcagctcaatgatctctgcgatgccgtcgcgacccacgatagcgggcacgctggcgtacacatcgtgctgaccgtatttgccgtccagcagaacagaaaccgaaagaacgcggttctcgttgtagaagatggcgcgaacgacctctgcggcagaagcgccgatgccgaactcggtgcactgcttgccgcgcaggatggtccagccgccttcacggcctgcgtcagcaagagcatccaggtcgagtttgccgaaggtgtccggatactcctcgcgccactgggaaagcggcttgcccgcaatggtgacagccgaccatgcgaccatctggctctcgccgtgctcaccgagcgcgtaagcggtgatggatttctggtcaatgccgatctcctgtgcgatggcgcggcgcagtcttgcggaatccagcgtggtgctggtggagaagatgcgctccggtgcccagttcagcgtgtgctggatgtaatgcgtgataacgtctgccggattggagatattgacgataatgccgtcaaaaccggattctttgatggattttgttacatccttcaagatggcgatggtctgacccagcgtatccatgcgggtctgattgccggtcggcagcgggcccgccgagataagcatgatctgcgcgtcctttgcatcgctgtaatcaccggcaatgactttggtgcggaccggcagatagttggtcgcatcggtcaggtcgaacgcctgtgcgactgcctttgcgtgatcggagtcaatgtagacgatctcgtctgccaaactctgcgaaatcagtgcgtagccgacatgggagccgacatggcctgcaccgacaataacaactttgcgattggaaatactcatgtcagacactccttaatgcgtgttcttcttgacgaccttgccgccaacgaactccataatacaaacaatgataacgaggaccagcacagtgacgttggtaacgtccagcatattgcggtcgtggccgtaacggatagcgaagtcgcccagaccgcccgcgccaacgacacccgccattgcggtcaggttcagcaggctgatggccgtgatggttgtgccgcgcgcgatggcggctacgctttccttcaggtaaacgcggaagatgatctccagcggcgtggagcccatcgagagagccgcttcgacgaggccgccgtccaactctgcgagggcgctctccacctgacgggtgaagaacggcaccgcaccgaataccagcggtacgatagcgccgcggacatagatggccgtgcccatgatggcacgcgacaccggcattacccatgtcagcaggatgatgaacgggatggaacggaacaggctgaccagcttgtccaaaatctgatagacgaccttgttctccagaatgccgcccggcttggtgacggtgatgagcacgcccagcgtcagcccgagcacgaacgagattgcgcccgaccagaccaccatgagcagcgtgtcaccgatggccgcgtagaagtccggcagctttgccattacgtttggaatgatgttattcagaaactcttgcatccttgatgacctccactcctacgtttttctcaatgagatatgcgattgcctgcgtgatctgttcacgctcgccgctgatgatggctaccgtgccgccgataggcgcatcctgcacgatggcaatatccgaaaagatgatgttgagcacaatatcgaacttgcgcgatacggtcgagatgagcggctcggatacattgcgctgaatgtagctcaggcgcacgataagctcgcccggattgagcttgacgaccggcgaatcctccgcgatgagttcttcgatcttgcggagattggaggtcgtgtggatgaagttcttggtgatgtcctctctcgggttggcgaaaatgttgaacacctcgccggactcgaccaccttaccgtgctccataacggctacgcggtggcagatctccttgacgaccgccatttcgtgggtgatgataacgaccgtgatgccgagcgtttcattcaggtgcttgagcagctgcagaatcgccttggtggtctgcggatcgagtgccgaggtagcctcgtcgcagagcagcacattcgggtcgttggccagtgcgcgagcgattgctacacgctgtttctgaccgccggacagctgcttggggtacgcctccgccttatcaccgatgccgaccagatcaagcaggcgctgtaccttttccgcaatctgctgcttggaaaggccgctgccgcgcagcggatacgctacgttgccggctacggtgcgcgagggcatcaggttgaagtgctggaagatcatgccgatcttcttgcgggcctgccgcagctcctttgccgagagcgacagcatatcctgaccatctacgatcaccttgccggaggtcggccgctcgagcagattgatgcagcgcaccagtgtcgatttacccgcaccggaaaagccgatcataccgaaaatttcgcccttgtcaatcgtcagcgaaacatcctgcaccgcatgaacggttcgcttgccgctcacaaactccttcgagatatgtgacaattctatcaagaaaattcctccttattcctcttaaatgcgcaaaaaagcgggaagctcgcagctccccgcttcagaaaatgcaatgaatccgcaaggacgcgcagcgtcaggcaagccggttcaaagtaatttcgtattctgtcggccaggcagcatctgagcataatacagcatgttcatacacattcgacccgacattcgtgcgtttacgatgaacattttgctcgctcccttccgattccctactggatttgttggttatagaataacacagccaatccccagtgtcaacctcggaattgtaggaatttcgttttctggcggttttgccagttttgtataaatcaagtcagtaaaatctatgggatttgactgacattttcagcagtttgctgtaattcaaagtggtcttcttggcaggcatattgggtaccgagcagttcatgcagggcgatatgccgcgcggcaccggagcgtggatcgaaatagcagctggcgggtttcctcgtcgattttcttgagtcgctcccttcgcgggagcgtggattgaaataggtcaaaatacacaaccgccttgagcgacacaaatagccgcatcacctccatcccttcacgattttccccaacccgaccaaaacatttgcacatgtcatgacacatgtgatataatagctccaataccgctattgacagcgccgcacagattgctgcggcgttttgccgggaaggagaaaaatcaaatgaaagcatactttgacagcatcgaaaaggaggttccggagcaattacagcaggttttccttaatcgccgcgatacggctgtcattacgatcgacatgcacgatggacacctgtcaaccgacccggactgtccatgtccgtctccgcgaggacgcgagatcgtcgaaccgctcaatcatttcatgaacgaagcacgcgcgctcggtctgccgatcatccatgtccgctcaacgctgcgtaagggcggcgcagacgaaaaactgtttccgtctgcgtggcgcatggtgtttccggttacggtcggtgagatttccaacatcgcagagcacgccatcgaaggcacacgctggaacagaatgtccatcgacgtacatgacgaggactacatggtgacgaccaaaaagcgcctgagcgcgttctatccgaccgatctggagctgctgctgcgcaacctcggcatccgccgcgtggtgctcaccggctgcatgaccgactgctgcgttatcaacacggcattcgatgccgcaaaccgcgatttccgcgtcgtcgtgccgcgtgacctgacccgcggctccgagcacctcgaagagcctgcgctgcgcatgatctcgctgcacctgggacttgtcgtggattcggatgcgctgctcgatgaatggcgctctcaggactaaatgcatacctgaaattacatataaacaagaaaacaaggtgacataaaatgaaaatcggcagaacagagaaaatctggctggcgtctgtgctgttcttctgggtattctataatttcccgggctttccgccctacggcagcgaaacggcctgcatcgtacacggcctcatcagctttgtcggcacggtgctgtccgtgtatatcggctgcaagctgaccgaaaaggaatatcctctgattgaggatgaggaacaggacgaaacggctgaggataatacgcctgccgcttccgaaacgcaaaaagaatcggacaaataaaggataacagagaaaatgacaacacagggtttactttcaggcaaaacggtatggatcgtttttgcagcatattttctatttttgatcgctatcgcacgctacaccacatggaaggaaaaacgtgacgcaggcaaggtcgatctgcagggcggtcggttcaagtggccggtcatggtcatgacctatatcgcctcctgcatgagcgtctgggtatttttcgcaggcccgggcgcgtattaccgctacggactgggctacttcttctcggagatgtgcatctactccatgttcccgatcatctgctacttcacgatgaccaaggtatggctggtcaaccagcaaaagcacttcaccaccccggcggatttcttcttctgccgctacaagtccaaggcgctgaccgttatcatcgacattgtttacattatctgcgccgtgccgttcatttcggcggtgctggtggcaggcggccgtgcggctgaggtcgcgaccggcggcgcggtatcctcgcagacatttacgctcatttgcggcattatcatgacggtattcgtcatgctcggcggcgtaaaatccaccgcactggcggatgctgtacagggctggttcttcattctggcgctgtgggcaattattttcgtaacgctcaagatcgtattcaacggctcgatcatcgaggcattccagaccgtccgcgtgcagacaccggactggttctcctatccgggtccgatcggcatatgcacctatccgtcgcgcgtcagctatccgcttgcgtgtgcattcggctacacgctgctgctgccgcaggttttcgtgcgctccggctattacagcgcgggtctgaaggaccagcgtcagatggcgttccttgcaccgttcctgcagatcatcgtctggggcggcacgatgctcatcggtctggtcgcgctggctgccatgcctgaccttaccagctcggaaaccgaactggttatcccgtatatgtgcaacatcatcgcgggcacgcacggtctgctcgcgcagattctgatgatcgtgttcctcatcggcgtactggcggtcggtctgtccaccgcaaatgcgctgctgatggtcatgtcctctatcatctacaaggatctgctagtcggtatcggtcactgcaaattcaagacatccgaaacctcggttatccgcgtggtaattctgctgttcggtgccgtaacggttgccgtatcgctcatgcactgggaatacgtctacaatctgatgattttcgcggattccctggtcgaatcgctgttcccggcgctggtattcggcatttactgcaagtgggcaacccgaaaagccgctatcacctcgatttcggtcggtgcgatcatcatctgcctgaccttcttcgtctgggatctcggctatgtgtggtacggcacgatcggtctggcgaccgcgttcgtgctgatgtatgtggtctctaagctgacaaaggatgacccgaaggacagcgaggacttttacgaggcgcttgactccggtcacagacgcttcatgcgcatcaaagcaaaaatcaagtaacggcaggagggcgaaatcccatgctacgatttacgctcaatggcacacaaattgaagtgcaggacggtgaaaaccgcacattgctcgaatatctccgcaatgtaaagtgcatgaagggcacaaaagaagcctgcagcaccggtcactgcggcgcgtgcagcgtgctggtggacggcaggctgacgcgttcatgcgtgacgctcgtgcaccgactggacggcaaagccgtcgaaaccatcgaaaacgcgccgcatgacaccatgctgcaaaccattcagcgctcgtttctcgatgtcggcgctgtgcagtgcggcttctgcacaccgggcatggtgatggcgacaaaggcgctgctgctgcaccatccggccccaaccgagccggaaatctgcgacgggctgaaaaacaactactgccgctgcaccggctacgtcaaaattatcgaggcggtcaagctggcagcggcgcggctgcgcggggaagatccggatatcgacagcttccgcagccacgaaagcacggttattgtggccggggaaaatcaggtcgtgcccgaaatcaccggttccgcggtcggcaagtcggtctgggatgtggacggcatggacaagaccggcggcaaactgaaattctgcgacgacctcaccgcggaggacatcggcgcggataccctgctgcacggtgcatttgtctgggcgccggcgccgcacgcaaagatcaacgcggtggactactccgccgccgaacaggcggaaggtgtggtgcgcatcgtgacggcggctgacgtgcccggcatgaacaaggtcggcacatggacgccggagcagccgatcttttgcacggatgaggtgcggtttctcggtgaccatctggcgctggttgtcgcggatacggcggcgcacgcgagagcggccgtcaagctggtcaaaatcgactatgaagaactgtccggtatctacaccatggcggacggctaccgcaaaaacagcttcatcgtgcacaccggccgcgtcagcggcgatgtggagcaggcaaagcagcggacggatatcgtcaagctcaacgtctccaaggagattgagccgcaggagcacgcctgcatggagcctgtttcggctatcggcatggtgcagaacggcaaaacgatcctctattcctgcacacaggcaccgtttgaaatccgcagtatgctggcaaagattctggacaagccggaggaggatatccgcgttatcgtgacgccgctcggcggcggcttcggtaaaaaatgcgactcatttctcgaagcaccggcggttgttgccgctcatgcctgcggtaagccggttaagattacgctgacgcgcaaggaggatttgatcctcaccaccaaacgccatggctaccatacggattacgagattggctttacgccggacggcaagttccagtatctggactgccgcatgttctcggacggcggaccgtacgagtgcgaaagctacggcacgctgatgaccggcgcgctgatgagcggcggcccgtacatcattcccaatgtcagcgtggagggctcggccatccgcaacaacaatctgcagggcggtgcgttccgcggctacggcatcaatcaggcggcgatctccattgaaactgcgatggacatgatggcggaaaagctggatatcgacccgttcgagctgcgccggcgcaatgccgtctatccgggtgcgacctcggtcggcggtgaggtgctcaaatacagcatgggtatgatggataccatcaatcaatgcgaaaaaagtttgcgaaaagcactcaaggagtacgaaggacagtatcccaagggcagcaaggtgctcggctggggcatggcctcgggattcaagaatgtaggcgtcggcaagggtattttcaccgatgacggtgcgtgcaggctgattctgcagggtgacggccacctgcatatgatcgtttccggcacggatatgggacagggctttcgtacagccatgacgcagatcgcggcggaaacgctcggcatggatatcgcggatatttacatcaccaacggcgacaccgagctgaccatccccaccggcgaatcggtttccgagcgccagacgctgtgcggcggccgtgcggtatatgaggcgtgcgtcaagctcaaacaggatttagacagccgtccgtggcagccgggcgaggaacgccgcgcggaatactattatgcatccgacccgtgcttcgccatcggtgattttgagggtgcaaagcagcgcggtgcaaaataccgcaattttccggcgtatgcgtatgccacgcaggccgccattgtcgaggtggacacggaaaccggcgaggtccggctgctcaaaatcatcgcggcgcacgatgtcggccgcgccatcaatccgcatatcatcgagggtcagatgcacggctcgtgctcgatgggacagggctacgcactgaccgagggatatccgacgaaaaacggctatccggtcaagacgctgtaccgtcagctgggtctgccgcgtgccgaggatacgccggattacgagattattttaatcgaggacccggagccgcagggtccgttcggcgcaaaaggcatttccgaggttgcgaccgtgcccgtcacaccggcgatcctgaacgccgtgtcgcgtgccatcggcgtgcgcatcaataaggtgcccgcgtcgcccgaagtcgtgcgcgaagccatccgcaccggcaagtgtgaggtgccaaccatggagcagcagcttcaggcgctcgaaaaggattgcgaatatcaccgtccgtcggacggtgtgcagtgaaatttcttgtcgttgtttacaatgacagtcgaaacagcatcaccacctatagcgcaaagacccggaatcttttttcggaagattccgggtctttgccgttttcacttattttccgtctgtttttttaccgcctctgcgattttgcgatactccggcacatccacgccgtactgctccgccagacgcacaacctgataaatcaaaccatccacctcggactgcttgccggcttccatatcgcgctgcatagaggtagacgcggtcggtgcaagcgcatccagaatgcgcaggttgcgctcgaccagctcccccggcctgctctccagcggaatacccatcttgtccgccagcgcaacgacctcttttatcaggcgtacaaagctgtcgcgcacctcgcccggatgctgcatttccgcagctttcgcgtgataatactgtccgcaggccgcattcggcgacacatacgcaaatttgagcagcgtgtcgcgctcgacatacggagaataaaccgggtcgattccggcatttttgaggtcggtctcgacctgctgcagcaccggatgatcggtcttgtggctcggcagtccgtacacgatacggcagatcgcaccgtgcttctgaatgacgcccggcgcaatcctgttggccgaaatgtagatgcagccgtccgtgacgagcagctcaggcagctccgcctgcagggcacggcccgtgccgtagatattgagcaccggaataactaccgtgtccctgcctgctgccttgcggatgaacggcacggtatccgcaagagagtatcccttgacacacacgaaaatcacatccggcgcgggagcgccctgctccctcgcggcaagaaagccgtccatgtcgatcgccttgaccggaatgctctcgcgctcattttctccggatacaagcgtcaagccgtgctcctgcaggaccgcaagatgctttccgcgtgcaataagtgtggtatccgcaccggatttgctcaaatacgcgcctaccggtccgccaacgccaccggcaccgataatcatataacgcagcttcatcctctgttcctccgattgctttttctgcattatagcacaaaatcggcaatgtatccacaagtctgtggatatctctgtgcagcgcgtgattctccgcttctgtcattgcatctgttcccttttcacgatataatgattttatatattctcacccgtctaatttgttcgacaaaattcgacagcctgcaaggaggtcattgcacatggctggcaacccacaaaagaaaagcactggcatcgtcaacgccgccattggcgcgctggcagtcgtgctggctatattgattgtctggatgatgaacctcgtttccggtattcagggcaccgcgcgtatcatcaactacgccggactcgtgcgcggcaagacccagcgtatcgtcaagctggaaatctctggtcagccacaggacggcatgatcgcagatattgacgcgtttatcgacggactgcgcttcggcagcgacgagctcagtctcgtgcggctgaacgatgacgccttccaaagcaaaatgcaggagctggatgactattttcaagcactcaagcaggagataggccgcgtgcgcgcagtcggctcaaataacacggacatcattcccatcagcgaaacctttttcggcatctgcgacgacgcgactggtctggcggaggcgtactcgcagcgcaaggcaacctcgctttccgctctggagaagtacatcacagcggatatcgtcgtgctcatgctgctgatcggctaccagctgtttcaggcgctgcacacggctgcgatgaaccgcgctctgcagcataaggtctatctggatgccgcgaccggcctgcccaacaagaacaagtgcgaggagctgctcgacgatccgacgccgcctgcgccagaaaccggcgtgtgcagctttgacctgaataatctgcgccgcatcaacaacagcatgggccatgaggccggtgatgcatacatccggcgatttgcggtcgcgctgcgtgcggccatgcccgaggagcattttgtcggccgtacaggcggcgatgagttcctcgcgataacgcacggaccggatgccgatgcgctgcagaaattgctttcccatgtccgtaaacagcttgctgaggagtcccgacagcatccggatacaccgctcagctatgcggtcggctttgcgcttgcatcggacaatccggacagcaatatgcgcgatctgtttgaccttgcggacaaaaacatgtacatcaacaaaaaccacgtcaagcgcgaggaagccgccgccgaaaagcggctggattttcagctgctgaagcaggtcaaccgcctgcaccgcagcttttccgactgcctgtactgcgatgcgcgtctggacacctaccgcaccatccgcgcgtgcgagagcttttttctggcatcggacggcagctacaccggcgccgtcgagcagattgccgaggaacaggctgctaaaagcgagcgcagccgcgtccgttctgcgctgcagcttgacgtactgcagcgcagcctgcacagcgcagaggataccctcgaactgcagtacaacgcggccgaggaaagccgctacagccgtttgaccgttcttccgattgactgggatgaagccggtgtgctgcaccactttatcctcgcgttcgagaccatccggctgaacgccgaccaagccatcgacccgaaggagcagctgacgctgtactacgagcagctaaagcagtctatccttgagaacgacagctatgtggacgcgctgctcgatatggcgagcacaatctacacggtaaacctcacgcgcgacaccctcgagcgcaacatttcacctgcgggcaagagcgattcggaccgggcgctgttcctcgactacccgcttccctgctcctaccgcgactactgcgacgagtaccgcaagcgcgtcacaccggcaacactcggcagctaccgcacggcagataccagtgcccgtctgctcaagcgctttgccgccggtgaaaaacacatcacggtggagtactgcgtgcaggaggatgacggcgctatccgctgggtacagaaaaccgtgctgatgacgcagaccaccatgtttgatccggaaatcaatgccgaaatgccgatggtcacggcgattatcctgctgcaggatacctcgcagatgcacgcccgcgacgagcaagagaacgcccgtctgcaggccgccttcgatgaaatgcgtattgcgaaccgcaccaaaaccgaatttctctcgcgcatgagtcacgatatccgcacaccgctcaacggcattatcggtctgctgcaggtggacgaaacccactttgatgacaaggcgctgctgctggaaaatcacaaaaaaatgcagatttccgccaatcacttgctgtcgctcatcaacgatgtgctgcagatgagcaagctggaggagggcacgaccgtcctcacgcacgagcgcatcagtctggtggagctgacccgcgatatcattaccattatcatcggccgcgccgaagaagccggcattgagtgggagtacgagaaggacaaatccatcattccgtacccgtatatttacggcagtccgctgcatctgcggcagattttcctcaatatttacagcaactgcatcaaatacaaccgtcccggcggtaaaatcaccacccttacggactcgctcggtgaacaggacggcaaatgcacctaccgctggacgatttcggatacgggtatcggcatgagtccggactttgttgaccatatttttgaaccgttcacgcaggaaaagcaggacgcgcgcagctattatcacggcaccggtctcggcatgaccatcaccaaggagcttgtcgaccggatgggcggctcgattacggtcacgagtcagcttggtgtcggctccacctttgtaatcactttgccgtttgaaattgcaccgtctcccgagcagacaccggacgcacatgccgcgccggatatcagcattacaggctgcaagctgctgctcgtcgaggacaatgcgctcaacgccgaaatcgcacagattctgctgaccgacgaaggagcgaccgtaaccgtcgtcacggatggcaaacaggctgtggagatcgtgcagaacaatccaccggacaccttcgacgcggttctcatggatgtgatgatgcctgtgatgaacggcattgacgctgcgaagaccattcgctcgctcaaccgaccggacgcgaaaacgctgcccatcatcgccatgaccgcaaacgccttttacgaggatgcacagaagtgcctcgccgcaggcatgaatgcccatctggcaaagccgctgcagataaagaaggtcaagcagacgatcgccgaatgggtgaaaaataaccgaactgcaaaaaaggacgcgtaaagcgtcctcagtctgtcgaaaagtcatatagtcagcatttttcagcatttcgcgcggcagcgcgcatatgaaatagcatttgctctgcaaatgctcaaaaagggggagcatgtatcaccctttttgaacttctggagggagaaagtttctgtataggaactttcggacgactttggaacggcccacggtccgttcctgcttgtcggcgaaactgtagtttcgcgacagcctcaaaggacgcgtaaagcgtcctttttcattctacagataacgcatcctcgctgattaccgcccgaatcccccatgacggcaccttatccggataggcttcgccttcgagcatgacaaacgccgcatcgtacttcggacgttttttcgggtagatgccgagtccgtccgtgaagtacagcaggccgcgcagatggcggaacgcgccttcggcatttaagcggtcaacgtgctcgaaaaccggacgaaaatcagtcgcagactgaccgatcagttcaaaatgctccatatattccgcgagttcccgcgcatttgtcacctttttgtccgagcgcagctgatcgtcgcactgcagaatacgcaggttgaaatgccggaaaaagctggtgttctcctgcaaaagctcataggtgcggctgagaaacgcgcgcacgagttcaccggaggtggacatcgaggtatcgatagcgatgacgaaatcctctattttccgcacctcccgcgtctctaacggctcgatcagcggcatatttccgaaatgacgcagtccgtaggcgtagtagccgtaatcgaacgaatccgcatccaccgagacctcctcccgcagagcggaaaaccggcgcaggaacgcgcggaaatcagtcgttttgcgggtggaaacggcaagctgctcccgcacagcctgaccgccttccgccttgttcgcgaaaaccgtctccatcgcggtctgcgtgcgctcggcctgctgctgccagcggcgctcctgctgatcgtcatcctccttgtaccacagtgtatgctcgtccaccgcgaacacgcgcgtgagcgtagcgcagtcgtaggagttcagccgcgtgcgccgaaaatgccgatataccgcctcggcggtcagcacgggtagctcgtcccgcagttcacggtagatattctgccgccgaactgacaccttttccgcctgcaggcagcggtaatccagcgaatccagcatgctttcgaccgcaatatcgcacgacagatcccatagatcggcatcgcgtccgcgtgtctttccgggatggcgcagcagacagtggaacagcgtgtgcagataggcgcggttgacgttcgcgcgggagcgctcgtactgctgcgccagccaggcaccgctgaaaaacagcacgcgcgtgtcggtagcgagcgtgggtgtatcgtaaccgtctgccgcaggcagcgccgccagcgcggaatcgaggaacggcaggttcatgtacagttcggtgcgggcagaaaacaggatttcgcgtccgatagaagtccagcgggaggactgcgacatagaaaacatcacctcacaggttcatcttgcatcgtagggcggggtgccctacggatttattgataacttctatatatttatatcataattcaaacgatttggcgcgtcccttggactgcgttttgccggcggctgacagcagaacggacagcgctgctgtctgctctgcttcgcgggcagacgtgcacgcggcatccacatcggcggcagagagcacaccgagcgacagcaggaaggtcaatgcagcggtctcgcctgccttggcgcaggactgcgccagattgccgccgtgggtgcgtaaaaccgtaagatactccgcttttgcggcatccgagagcgcaaacggtacggcaagccgccgcacggctacacgtgccgcgaccgaaaaatcgtgccgctcaagcagttcgctcagggcagcatcatactgccgaaaattcagcacaccgctgtcaaagcactggcggtagctgtatcctgcgccgtgaatgcgtcgctgaaaaatatgcgccggactgaggtcctccagttcctcgacgtactcggggaacagcagccgcgcgtgctcatcaaaccgcacatcgagttctccggcgtactcgccgagcagcctgggcaggcaggtcggcacggacggtgcggcgtgcaggatgacttcgcgcaggctcatgcagttcatgagagcaccgccgccgaattcgctgacggaatcagtcagttcaatgcgttcaaggtttcggcagttataaaatgcataactgccaacactttttgcatccttcgggagcgtaaccgtgcggatagccgctgcattatgcttcggctccgtgccgccgcaggtgatacggacagcgaacgtgtccttgtctgtcagatcggggacccgctcgctgagtacatacgcgccgacctcggtaacaggcacaccgtctatctcatccggcagacgcacaatatcgtcctgcgtttcgcaccgcaaaagcgcaatgccgccgctcgcactccgcgaacaggtcagccgcagttcgttttcgccctcgatcacccgcatttgcactcatgtcctttctgctttttcattctgctacccattatagcacagtgcgcagaaaaagacgataccgcggccttcattctcataataagaatttataacagaaataatatattgttttttgcaaatcgcacttgacaatccactgttttgcgaatatactgtgaccataccaagtaaaccaacacaaaccaatgacgaagacgagtagcagggagaccgaacctccaagagagccgcaggcggtgtgattgcggcaggcaaggaccgtgtgaatggacttcaacagggcaaggcgaacggcttcggccaagtaactgcgacggggactccgcccgttatcagggaagcgcgcattgtttgatgtgtgagcagagtggacgcagtttgcgtcaatctgggtggtaccgcaagagcgtattcgctcctgtcccaagagaaatctgggacaggagctttttattttgtaaaacaaattgagaattgaaaatggagaattgagaattgtggtatcgcgcaaagcgcgatgatttaataaacgcgctctgcgcgtcacattcattttccattatccattatcaattctccattactgcaaaggagtaatcaccatggctaagatcccccacagactttatttgaccgaagaccagatgcccaagcagtggtacaacctgcgggcggacatgaaggaaaagccggacccgctgatccatccgggcacgcaccagccgctgccggaagaagcgctgtatcccatcttctgtcaaaagctggcgcatcaggagctggacaacgacactcgctacattgatattcccgagccggtgctcgatatgtataagctgtaccgtccgtctccgctgtgccgcgcgtacaatctggagaaggcgctggacaccccggctaagatctactacaagtttgagggcaacaacacctcgggcagccacaagctgaattccgcgatcgcacaggcgtactacgccaaggaacagggcctcaagggccttaccaccgagaccggtgccggtcagtggggtactgcactctctgaggcatgcgcgtacttcggactggatttgaaggtattcatggttaaggtctcctacgagcaaaagccgttccgcaaggccatcatgcaaacctttgacgcgaatgtaacgccgtctccgtccaatacgaccgaggcaggccgcgctattctggcacacgatccgaccaccggcggttcgctcggctgtgcgatttctgaggccgtagaagtggctactacgcacgagggctaccgctatgtactcggctccgtgctcaatcaggtgctgctgcaccagtccatcatcggtctggagagcaagcaggctatggaaatgctcgatgagtatccggatatcgtgatcggctgtgccggcggcggctccaacctcggcggcctgatttccccgttcatgcaggataagctgctcggcaaggctgacccgcgcatcatcgcggtggagcctgcgtcctgcccgtcgcttacccgcggcaagtatgtttacgatttctgtgataccggtcatgttacgccgctggcccgcatgtacacgctcggcaacggcttcatgcccgcgcccaaccacgcaggcggcctgcgctaccacggcatgagtccgatcctctccaagctgtaccacgacggttatatggaggcggtttccgtcaagcagaccgacgtattcgacgcggccgttcagttcgccaaggtggagaccattcttccggcgccggagtccagccacgccatccgcgccgcaatcgacgaagcgctcaagtgcaaggagaccggcgaagctaagaccatcctgttcggtctgaccggtaccggctactttgatatggcagcatacgaggcgtatcacaatggcaccatgcgcaaccacattcccaccgatgaagagctgcagatcggctttgataccattccgccgcaggaataaaacgcaatataaggtatatggcagacctccaatttctctgctgtatatagccgcctgttcccccacaggcggctttgttttgccaaaaacaggtttccgaaaaaactttcaaaaaatctgaaaataattgttgacattaggtcccacccgtgatattataataaggcagtcagcgagagcgacaaagcgaaacgccgacagcgaaagaaaatagatcttgtatgcgccagtagctcagctggatagagtgtttggctacgaaccaaaaggtcgggggttcgaatcccttctggcgtaccagatcaaccggttatttcgtaagaaatgaccggtttttcttattttctgatataggtaaaagtttttgttccaatttgcgagaggcaatataaagatgccgccgccataccggcatacgagccgaatacctaactttagccctaaaagaaaccctgtctgttccaacaccagacagggttttctcacttttacagcacttttacgcccgcgttctcgcacgccgaaaggaattccggcggcagtctgccgtccgaaatgacggtatctacctcatcgagaccgcaaatgcggaatgtacttcttcgatcaattttagaggaatccagcagcaccgccacatgctccgcgcgatgcagcacagtctgcttgagcagcgcctcctcctcgacaccgcaggcaaagccggtctccggactgtagctcgtcacgccgagcagcagcaggtcaaaatgcacgccctccagttcttgaatgccgcgcacgccgcacacgctgtggctgaaccggttgagcgtgccgccgggaatggacaccttgggcttttccagccgcgcgagttcgatcgcgcacgtcaatccgctcgtgaagatcagcatcggctcatcaggcacacagcgtgccacggcggttgccgtgctgccggaatccagaaacaccgtggtattcggccgcagcagcgccgccgccttctccgcaatgatctgcttttccgacgcattgcgcgccgtgcgcctgccgaactggtcgtccgtgccgacgactacctcgaccgatttgacgccgccgtgcacgcgaaccactcttcgcgcctgatcgagtgccttcagatcggttcgcagcgtcatttcggacaccgacggaaaagcctccttcagctgtacaaagctcaggcttccctctcggttgaccagttcgacgattgcattgcggcgttgttccatcggttgtttcctccaattagtcgtgctgctgaaagtttgccagcagatattcctctgcctccgggcaccacaggccgttgtgtgcatccacaatgtcagccagcgcggtaaaccgcgcatcctccgcaccctttgcacgcagctcggtcagcgcgatgagcggcatggtcaggtgcgtgtagatgagctttttgccgcccgggatcttgggcaggttgagcgtagtctcggctgccgcattcagaccgccgatatgcgtcaccataaccgccggatcgatgcggccggatgcggtcagctcgagcgattcgatcatatccgcggtgttgccgccggtcgtgcccatgacgtgtgtagagttgtagtgtacatcgtaaaaattcatcttggcagaaaactgcttgtcggtcgggccggcgaagaagttcaggcagccatcgcggccgagcaccgcgctgcaaagctcgacaaccgccgcaaccggcgcgtagcagaatacatcgtcaaaaccggtgccgccggtcatttcgcgcagctctgccgccggattctccatcttgccggtgttgacaaagtgcagctcgatgccgtccttttccttgacctcggcaggcgggaacagcgcctcagcgcgtgccagacggtcctcgttcacatcggtcacaacgaccatggacggacggacgtcacggtgcagcgcatacgtcagcgcacccagacccatcggaccggcacctgccatgatggccagcttgccgccctttttaatacccatttcgtggtgataaacacccatcttggtgtgataagcggcgttgaacgcaccgatcgagcagctcatcggctcggcaagagacgcctcgtagtaggcacgccccttgtactcgagcaggcagccaagttccataacctcagccggaatgatgcagtaggtcgcatcgccgccgaagaactcgtaggagtatccggggctccacatcgtgcccttgtaattgagcgccggctgcagcgtgaacttcatgcccggcttgaacttatcctgatgcttcgcgccaaccttgacaatatcgcccgcaaactcgtgacccatgatggccggatgctcggcaacatcgggatgcacacgcttgtgctcggtaccaaggatcgcgcacttgtaggtggacatgcagatgctgtcggatacgaccttgaccaggatttcgtcgtcacggatttccggcagctcaaaggtatccagacgcagatcattcgcagcatgcagacgtacagcccttgctttcataataataactctcctttatcacttaggcaatagatttcaacaattacagcttggaaaaacgtactttcggaagcagctcctcgataaccgagcgctcggcggcctgtgtgccgctgcacatgacattcgcggctccggtcgcagtcgagagacggacagcgtcctcctcgctcatatcctgcgactcggcatacgccagcgcggccaccacgctgtcacccgcaccgaccgtactgccgaccggaaccttgagtccctcagcataaatcgtgctgcccttgcgcagatacagcgcgccgcgtccgcccagcgagataaccacccgttcgatgccgctctccagcagcttttgaccctctgcggtcaactcttcgatggtttccagttttttgcccgccagacgcgacagctcatcatcattcggcttgatgaggtacggcgcggcctttaagccttctgccagtaaagcgccgtccgcatcgaggaacacccgcgcacctgcttttttgcatgcgctcgtccacacgcggtaggtatcctgcggtgcgcccttcggcagactgcccgccagcaccacgatgtcgcctgcatgcacctcagccagaaggtcgttcagcagcgcatctaaatctgcgttcatgacggtcagacccggctcattgatgtcggtattcgtgcggccgacccggtcaatgattttgatattcgtgcgggtctgcccctcaacgaaccggaactgcgtggtgaaattctcgttttcgagcagcttttcgagcgttctgccgctctcaccgcccagaatgccgactgcgcggctgtctccgccgagtttggcaatcaccttgctcacgttgatgcccttgccgccgggatccgtgcgcatttccgtgatgcggttgaccgtgtcaagcgccatacccggaatttctaccgttttatccaatgcggggttgagtgttaccgtatagatcatggaatgacccctttcagatatttgaaactgttgaaacgaaagctataattataataccaacagtcagcgcaagcgtcaatctgttatttcaacaaataatccctttcgtttttgtgatgattcacaagagcgcattctctctgtaaattctgttctgcgcgcaaaaggagcagcaatgcagaatattttccgcattaccgctcccttttatgcttaatttccgtgttctgagaacagacgatccagcttttcttccaacagctgcacggctgcgtcgcgctgaccggtccgcaggcgctcgatcagctcaggctcctcgatcagctgtgcgctcaccatgcgcatgacctccaccggaatcggatcatcggtatccggcgcaagcagcacaaatgcccccataatcatctttccggcctcgtagaccggcggctgtgcctgtaaatagccgaatcggcagtccgataccgcctttgtcctgcaatgcagcagcagcgcgaacagcggcttgatataggtatcgcccatggtttcccgtcgacgcagctgctgcgccaccagacacgatgcgtcctcattcgggcagaacagacggcttgccgcgtcaatcaggccctgccgcgaaaccggtttgcacacagtccggatgcataaatggtcgagcatctgcaccatcgagcgcgtgaggcgataggtgtagcgcaggccgccttcggccgccgaggcggcagacggctctgccggtgtgccggtccgcacggtgccgttcagccgctgcaccgcatcccgcagaagggcgcggtccggctcgagcagcgcgggattgaccgtaatcgacggatacgccagctcgagcggcacggttgcaatcacaaggtcgatgccgcggctgtgcagctgctctggatcgagttcgcgcaccgaacagcagccgtccaccttgagggtcgggaattcgccctcgatacgcgaagccagaaatcgacttgagctcatacccagcgggcacgcaaccaccacgcgagcggcctgccgcagtgcgccgttctgctcgagcaccgcgccaaagtgcatggcaagatatgccgcttcgctgtccggaatgtgcggcaacgccagttccatctcgacggtgtcgcatgcggcgcgtgttgccgcccacaactgcggatattcacgctgaatcgtgtccagctgcggattatccatgtgaatctgctcacgcacgcgcagcagcatcggccgtaaatgcgtaaacaggttgtctctcagcgatgcatagcccgagaaatccacgcgcatcgcgcgttctacctcgctgatcagccgtccggtcagatggcgcaggtgcatctcgccggctccccatttttcgccatcgtcaccggtgatatacgctgccagatactgctctaaatactgcacttcctcggtcggcagcgtcagtccgaacgcctgtcccaaagctgcccctaaccgctgtgcggcgttttccggcagatgaactgcggcagacgaaccgccctgttcgcgcagctgctgcaccgccagcgtgcagtggatggcaagcgtcaggaagcccgcatccggcagacggagcttctccttctgctcgaactgctgcagcacctgccatacccgctcggcgattttcgtattcagcagcgcggcaaatgcgccgcctgcagcaaaattaccgcgcagcaccgcctgcagctcttcttcggtcaggctgctctgcagcagcgcggcagcggcacggcggcaggacagcttttcgcccttgagccatacgcccacaccgggtcggcggtgcagcgtcaccgcatacgaggatacccactgcccgatttcgtccagatcggcggccagtgtgctctcggagacgagcagctcccgcgccagtgctgcggttttcatcggctcacgcgcctgcagcagcataccgagcagcttttgccgccgctgacggcgcggcagctccgcgtagactgtgctgccgttcagcagcgcgcgcatttgctcccggcgtgcgggcggctcgtccagcagcagtccctgtcccggactgcgtacaaagcgatagcctgccgcggcaatccattgctccacactcggcagctcacgcagcaccgtgcggcggctcacgctgatgctctccgcgagcatcgccgccgtcacccagccctgtggcagcgtcagcagacggtcgattaacttttgcccgttcgcagtcagcgaaggcagggtttcagacatcgggatggctcctttctataaaatccaacaggtttagaatggaaaatgaatgtcactgtcagcatagtgcattcatttgtaaattcatttgcaatcgtgtatacgttaattctcccttttccattctcaattacttatctctatgataccacattctaaaatgacagcacaagtgacactgttccgtatcctgcgttttttgtcaccatctgccggtgacacaactccgacaacccgctctgctgtcacctctgttctgtgcagactgcacaagcagccatcctttcccctgcgcgttttcgacagtcttacgacatttgtcaccattcgccggtgacatcagtcactatagtttcccttgtcagacccggattccgcctgtacaatatagtcaaacgaaacgaaagcgactccccgaatcccgcaagtcatgcggcaacacagataaggagttgaaaagctatgaaaaacgcaatttcccgttttggcaagtttttgagcggcatggtcatgccgaacatcggtgcatttattgcatggggcttcctcacagcgctgttcatcgaaaagggctggttcccgaacgaacggctcagttcgatggtctcaccgatgctgagctacctgctgcccattctcatcgccggtcagggcggctatatggtcgcaaaggaacgcggccgcgtcattgcctgcatcgccgtcatcggctgcatctgcggctcggactacaccatgctgatgggtgcgatggtgatgggcccgctggcaggctgggtcatcaagcagtttgacaaccgcgtggaggagcacattcccgccggttttgaaatgctggtccacaatttctccatcggcatcctcggcatgctgctggcgatcctcggctactacgttatcggcccgtttatgaccgccattctcaccgtacttaccgcaggcgttgattttctggtcagccacagcctgctgccgctggtttccatctttattgaaccggcaaaggtgctgttcctgaacaacgccatcaaccacggtattttcaacccaattggcgtcagccaggctgcagaggccggccgctccatcatgtacatgctcgagaccaatcctggtcccggtctgggcgttctgctggcgtactgcctgttctgcaaggacaagaccacacgtcagtccgctcccggcgcggttatcattcacctgctcggcggtatccacgagatctactttccgtacattctgatgaatccgatcatcattctggctccgatcgcgggcaacttctgcgcgatcctgttctacaccatgaccggtgccggcctgtccggcccggcatcccccggttcgatcattgcctacatggcgatggcgccgcgtgactccgttctgacggtatttatcggcgttgtccttgcagctgccgtatcgtttgtactctcgtctgtcattctcaaagcaacttccggcaatgcgcagaacctcagcgaagcgcaggccaaaatgcaggacatgaaggcgcaggccaagggtgaagcacccgcagccatcgaatccgcaccgataaacgccggtgacgtgcacaagatcgtcttttcgtgcgacgcaggcatggggtcgagcgcgatgggcgcgaccaagttccacaaccgcatcaaggccgagcgtccggagctgatcgtcaccaactccagtgtagataacgtacctgctgacgcagatatcgttgtctgccaacgtgttcttgccgagcgtgcccgcaggagtgcaccgcaggcgcagatcatcaccattggcaacttccttgcggatccgaatctggacaccctgtaccagacgctgaccgctgcacctgccgcgaaagccgcggctcccgaaaccactgacgaacctgccgcgcaggatcagggccttgtaatccaggccgaggacattcagcttggcttaccctctgttgataaggaaaccgcgatccgcgccgcaggtgcgctgcttgccaaacgcggctatgtcgatgccgactacgccgatgcaatggtcgagcgcgaaaagctcgttaccacctacatgggcatgggcgttgccatcccgcacggcacgagcgaaaagaaatccactgtcaaaaagtccggcgttgtcatgctgcagtaccccgacggcgtagacttcggtgacgagaaagcatacctcattttcggcattgccggtgtcggcgatgcacaccttgacctgctcgcccatgtctgcgaggtcctcgaggacgaggaggcgcttgaaatgatgaagaaaaccccggatatcaagtttgtactgacccacctgcagtaaaaggagagattttcatgaaacagtttaccatcaccattcaggataaggaaggtctgcacgcccgtccggccggtctgctgagcaaggccgccaagggcttccagtgcgcagtaacgctcaccaagggcgaaaagaccgctgacctcaagaagattttcgcagtaatgggtctggccgtcaagggcggcgacagcatcactgttgcctgcgacggcgcggacgaggaagctgcagcggctgcgcttgagaagatgttcgctgagatcaagtaactgaatttcgacacaatcaaacctgaaaaaccaggagagggataacctctcctggtttttcctgttccgaacgcaaagggtctcccgccgaatggcgggagaccttttcagtctgtcgataaagtcaatctatcgtttttacttttcgtgcggcagcacgcataaaatagaatttgcacagcaaattcataattcccgggggcgcggcccaggccaccctctcttgccgctatgcggcaattcaccttgtgcacctcgggaattatacaagggacgaaaaattgtgcccgtagggcgcggcttttcgtcaagattcgattgaaagcgtggtttcaatcgagaggctgctcgaaaaacggagtttttcgacagcctcaaagggtctcccgccgaatggcgggagaccctttctcattttaccggcttatttaccggtcttttcacacagcttctgcatgataacagctacctgtgcacgggtggccgtgccctgcgggtcaaaacggttgcccgatttgccgctcagcagaccagccttctgcattctggttacagcgtccttcgcgtaagcgcggatgcttgcgctgtcggcaaatgcggctgcactgccggtttcctctaccttagtgccggtggtggtcagataattatccatgataaccgcagcctgctcacgggtgatgagcgcattcggattgaaatgcgaagcgtccacgccggaaacaatcttgttggctgctgcccagttgacgtatgcgttgtagtacattttgctgtctacatcggcaaactggctctgggtgttgtacgcggagatgtctgcgcctgccatacggccaagcacggtgacaaacatgccgcgggtcatgccctcgttcggggagaaggtggttgcggtcgtgccgttgaacagcgccttatcggtcacatattcgatggcatcctttgcccagtggcccgcgatgtcggtgaaggtgcttaccgtaccctcaacaaccttgacattcttgcctacggtgccgtagttgtcgtaatccacagagtaatcgttgaatacatcatcggattcgtagcctactgcatcggtgaaggtgccctcgttccagtctgccagcgttgcccagatattggtattgccagccttgatggaatacgagttgataaccggaatatcggtggacttctctgcaacagaggagttcagtacggtagtaacgcgaacatactttgcactgcccagtgcggaaatatcaaccgtgttcttgccgttcttcagctctgcggactgggaagcctttacggtcttgccgtcgtccgaggtctcaacggttgcggttgcagaagccgcgccggtgatctctgcgttataggtaaactgtgctgcactgccggtcattgcgcgccactcggtggtgtgcgtgcccttggtgacgatattctccggtgcgtaatccagccatacgaccagcttgtcgctttccggaccctttgcagtcggatttgcgtaaatctgcttgttctcctctgcggtcagcttggtggtgtagaagcggagctggccgatgtcgcccgtcagcatggtgtgcgtcttgccacggccgcggcccgtcagcagatgacggtggaatgcaaagccggagtacatggacttgccttcccagttgcggatctcagaatcaaaatccggtgcatcggtgtgaccgcttgccttggtatcctcgtagctgtcgccgccggttgcacgatcaaaaccgccggtgtactgtacccacttgccgagggtaacgccgccgcccatattctcgtcgtcgttccagaagtactcgccgttatcgttgttaaagccaacgccgtaggtgaccatgccggtcttgcggactgccatgcggaacaggtagttggtgccgtagctgatggaagcgcccttcatcagcagcgggttgtggtcccactcatcgcccgttgccagacgatcgatgtttgcccaaaccatgccggtaacgccgttgtctaccacatagttcttgttatccggaatttccacataatcgtccacgccgtccagggacagaccccagccgccgttgtacttaacgagcgtcggattgccgcggatgatgccgtcgttgcccttgccggacttatcctttacgatcggggtgccctgaatagagccgagcacggcaacggtcttctctgccgagttgccgaccttgacggtatagctgccgcctgccggtgccttgtaggcaaactcaaccgtgcgggtctcgcctgccttgagcgcagtcttctgcgaggtaacggctgcgccgttgatgtacagcactgcctctgcggtgccgtcctcattgccgatgttctgcacatccgccttggcgtagatgacatcgctggtcggctcgcttaccgtgccgctgccaagctgcaggcgcaggttgctgtaggcgtaggtcgccttgcggaaggtaacattgactgtcttggtgtagctgtccagcttgagggtatgcgtgccgagtgcggaaagcgtcagcggtgcgctcagcgttacggactcgccgggattcagaccgacaacgcgctccttgccgctcttgccgaactcatacagccagcggtcggtgccgttgtccttgacacacatggaggcagtcgccagacccttgccgacattggtcacctttgcggataccgtgacagtgccgttggactgaacggtgtccggggtgatggaaatatcgctgtacgccagcttggcgccgtccttggacagcgtaaccgtctcaaatatcttctcgccgtcgctgctcaggcccagattcttataggtcatcagaccgtccttgacggttacttcgagcatatcgcccttgccggttgcaagcaggttgggatagttgtcattcaggcgctgatccggcttgccagtgtcgatcttgccgtcgccgatgcgggcatcgccctgggttacatacagggtatccgcgccgcgcttcggatcagcagaagcatagcgggaatacagatgggtatggccgctgaacatgatatttacgttgccgttctccacgatggaaggaacgtacttgcgggtcagatcatcctcgaacggatggtgcatggtaacaacgcggaagtcagccttcttggcatcgtcggttgcaagatcggccttgagccagtcgagcgactcgtttacaacggccttggttgccgcatccgcctcgccgccgcctgcggtggagttcagctcaaacagggaccacgggttgctgtccagcatatcgaaatgcaccggaccgcagtcaaacgctacgttgcgtccggtcttgttggacttatactgctccttctgcaccttggtgacatactcatcaaagtagacaccgtaatcgtggttgccgctgttgtagataaccggcacattgtgcaggaacgagccgacattctggaaccagtacgggaactgatccttctgagagccggtgccctctaccatatcgccggtatgcaggataaagtccggatcgaactttgcgatcacgtcggaaaccttggttgccgtttcaaagcgatggctgtcgctgacaaccacaaagcggatctcatccgaattttcgggcagcgtgcggaagtgaccatccatagtctgtccgtcctcggtctcaaccttgtaggtataggtcgtacccggagtcagatcggtcaggcgggcacgatacatgtgcatgctctcacccttaaacttttcgccctcctctaccggaacctcgagcgttttcttgtccgcatcgctcgtaccgtaggtaatggtggacttcatcggtttatccagttcccaaacgacaaccatgccgtttgttttcggggtcatcaggtacggacccgtcagaaaggagccggtatccgtccttccgattgcggaagcagtgctcggcaccagtgttgccagcatcacggccgacagcgcaccgctgagcagcagccgcatacgcgaagattttttagccatttactttctcctttctcttcacggtacggctgctgccataccgccgcgtctatgttaaaccttttaagttaaggcaataccgcataattgaacaagagtgatttgcgagtaaattttgcgtactgacgaggcccagttttgcggtaatacttgatgtattaccgtgaaacttcggcagcgcggacggaactcgcgcaaggaaccgaagccaaagtcaggacacaaaatttccgcaaagcaccgcggcagtgcgaccagagcctgcacaaggagccgccgctttaattgtgcggtgttgccttaaggtccgcgcgctgtaaatatgcgtgtcgaagtacgaaatcagccgcgtgcggttcttgcctgcccactccaaatcgtaggtgatgagcttgacctcgtccagcgacggcagtccatctgctgcacgggcggtgctgtttgccggaaggcgacagcttgactttgttgcagtttcacggtaatacatcaagtattaccgcaaaactgtgcctcgtcagtacgcaaaatctactcgcaaatcactcttgttcaattatgcggtattgccttaaatcatcgcgcgcagcgcgataccacaattctcaattctccattatccattctcaattaaatttcccatcggagtgaaatagatggaaaaagactactttgtgccttttgccgattacggcgaggataaatttgaagaaaaacgctccaagttcaccggacggctgtggcacgttgaaaccgccgaagaggcggtagcgaagataaaggagatgcgcgagacctactgggacgcgacacacaactgctacgcctacattctccgtgaaggcaatgtgatgcgttactcggatgacggagaaccgcagggcacggcaggcatgccgatcctcgaggtgctgcgccacgagaacctgactgactgcgtttgcgttgtcacgcgctatttcggcggtattctgctcggcacgggcggattggtccgcgcgtacacgcagggcgcgcaggtggctgtcgcggcggccggtgtgcagagaatgagcctgtacacggtggcgctcatcgcgtgcccgtacaatctgtacgagattattctgcacctgctgcccgatcacgactgcgcggtcgaggagaccgactacggcgcggatgtaacgctgaccgtgacgctgcccgctggtcgggaggacgagctcaatcgggcgcttgccgaagccacggcagggcaggtttacgccgaggtcatggagacccgattcatgggtcggcgtgtcaagtaaatatcggcttgcaaggctcacaaaattctgaaaaaatttttgtgaaaaaaagaggattttcagatttcgtttcgtataactattatgtgacggattctccgaggctgaggaggcggtacatatgaccattcgagagcagaacgaacagcgcgagcacgcggtgtttgagccgtgggcgacctttgcggacagctccgcaggcaggctgcgcccgatggaaccgtgtccgtaccgcacctgctttcagcgcgaccgggaccgcattatccattcaaaggcgttccggcggctgggcaacaagacgcaggtatttatctcgccggagggcgaccactaccgtgctcggctgacgcatacgctcgaggtcgcgcagattgcgcggaccatcgcgcgggcgctcggactcaacgaggatttgaccgaagcaatcgcacttggacatgatctcggacacacgccgttcggtcacgccggagaggcggcgcttgacgaggtttgttcgttcgggtttcggcacaacgagcagagtttgcgcgtggtggatgtgctcgaggatttgaaccttacgcgcgaggtgcgcaacggcattgtctgccataccggcagacgcaaggcgagtacgccggaaggccgcattatccactttgccgaccgcattgcctacatcaaccatgatattgatgacgcggtacgcgcgggcattatccgcgagaacgatattccgcagcatttgaggaaacgcctgggtgagacgcacggcaagcgcattgacacgctggtgacggcgatgatcgagtacggtcagcaatatctggagatcggcatggacgagcagatgcacgcggacatgatggagctgcggcagttcatgttcgatcatgtgtaccatggcacggctgcacagcgcgaggaaaaacgcgcaaaatccatgctgcgcagtttgtacgaatattttatcgagcatcccgacgagctgccggatgattacttcgtgctgcaggcccggggggaggcgctcgagcggatcgcgtgcgactatgttgcaggcatgaccgaccgctattcgatagcggtctataagaatttatttattccaaaaagctggaataagattgaggattaacgaaaatgggtatcatatattcgttttcgttcgataaatagggaaggaggggcacgaaatgccgtttgaccgtatatttctggacgagctgtccgcgcggaacgacattgtagagatcgtttcgcaatatgtgcagctgaaaaagagcggcgcgaactatttcggtctgtgccctttccacaacgagaaaaccggttcgttttcggtttcgccggacaagcagatctttcactgcttcggctgcggcgcaggcggcggtgtcattacctttattatgaaggcggaaggtctgaccttcccggatgcggtacgctatctcgccgagcgggcgggcatgcagatacccgaacagggcgaagccgagcgcaaagcggcgcgccacagagagcgtctgtacgcgctctgcagggatgccggacgctattattacgacacactctggcggccggaaaaccgaaccgcacagcagtattttatcaaccgaggtctgtcccgaaggacgatgaaccgtttcggactcggctatgcaccggattccttccacgcgctcatcgatgcgatgacggccaaaggctacacgcgcgaggaactcatggacgccggtctggtcagccgcagcgaaaagggacatatttacgaccggttccgcaaccgtgtcatgttcccgatcatcgacgtgcgcggtcatgtgatcgcattcggcggccgtgtgctggatgattccaagccgaagtacctgaactcgccggaaacgctgatcttccacaagagccgcaatctgtttgcgcttaacctgtcaaaaagcacgaaaaacgattattttatcttagccgagggctatatggatgtcatcgcgctgcatcaggcgggatttgattccgcggttgcatcgcttggcacctcgctgaccgaggagcaggcgcgcattatcgcgcggcataccgaccgtattgtcatctcgtatgacgcggacggagccggtcaggcggcggcacagcgtgcgatcgacatcctgaaaaaatgtgatctgcaggtcaaggtgctgcgcattccgggggccaaggacccggatgaattcatcaaggcacgcggcgcggatgcgttccgcaatctcattgaacgcagtgaggatcacaacgcgttccgcattgagcagatcgccgcaaagtacgatcttgaggacgacgaagcacgcgtgctgttcctcagagatgcagcgcgcatgctcgccggcatcgagagcaccattgagcgcgaggtctacgccggacgtgccgccaagatggcaggcgtgaccgccgaagccatgaacgttgaggttcggcgcgaactcggcattcagcgcaagcggcgaaaggccgccgaacggcgtgagatacgctctccggtcggactggcgcagccgaaggacaggtcgctggcgtataccgacatgaaatccgccaaggccgaggagaacgtgcttagacttctgttctcggaccagaaattgattgccgttgctgaaaaggacttgcagccggcgtggttttccgcaccggtgctgcgtaagatatacgagcgcgtgctggagctgaaccgaaacgaccagatggtcgatgtgctgtcctttgagggatggctggagcctaacgaaatgagcctgctgtctgcgatactcgaacccggcattccggccggagagcatcgaggggaactgcaggaatacataaacaccatacgaatgcagcgcgtcaaggatggaaccattacgcaggcgggagaggacccgctgcttacattcggacgcatcaaaaaacaaaacgcgggaggacaaacgatatgacgaaagcaaacgcaaatgcagccgcaaacgcacaggagcagcaggcagcacagcagcagatcctgcgcgacctgctcgcgcttggcaagaagaacggccgactgaccctcaaggagatctcggatgcactgagccatctggagctgtcgagcgaggacatcgacaaggtgtacgagacgctcgagaccatgggcatcgaggtcgagacgaacggtgtgctggagaaggtcatcggtgacgatgacgactcctttgagccggaggaagtggaagaggttccggaggaagaactggtcgatacctctgccatggctgagacgttcgccattgacgatccggtccgcatgtatctgaaggagatcggcaaggtcgatctgctgtcccccgaggaggaggtaacgctcgcagagcgcatgcagaagggcaacgaggccgcagagcgtatcgcaaacgaaggcgatgccattccggcggaggagcgcgcacagcttgaaaaggatatcaagctcggcgaccgtgcaaagaagcgtctggctgaggcgaacctgcgactggttgtctccattgcaaagcgctatgtcggccgcggcatgctgttcctcgatctgatccaggagggcaacctcggtctgatcaaggcagttgagaagttcgacagcaccaagggctttaagttctctacctacgcaacgtggtggatccgtcaggcgatcacccgtgcgattgcggatcaggcgcgtacgatccgtattccggtacacatggttgagaccatcaacaaggttatccgcgtttcccgccagctgctgcaggagctgggccacgatcccagcccggaggagatcgccaaggagatgaacatgccggttgaccgtgtgcgcgacatcctgaagatcgcgcaggagccggtatcgctcgagacgccgatcggcgaggaggaggattctcacctcggcgacttcatcccggacgacgacgcaccggaaccggcagaggcggcctcctttatgctgctcaaggagcagctagttgaggtgcttaagactctgacgccgcgtgaggaaaaggttctgcgcctgcgcttcggcatcgaggacggtcatacccgcacactcgaggaggttggcaaggaattcaacgtaactcgcgagcgtatccgccagatcgaggcaaaggcgctgcgtaagctgcgtcatccgtcgcgctccaagaagctgaaggatttcctgaactaaagaagcccaaagccgcttaccgacaggtaagcggcttttttatggaaaacggagaattgaggatggagaatgaaaccgttgcgttaattctccattctcagttactgcgatattcgagataccgcaaaaatgcttgaccgccggagatgcgtctatcgtgttgcaaaactgcggcagaatattgcctgagatcggcggaacggccagctgtgcaaaatgctgtcacaggctttcctttgtcagattgtgcgaagggtgttttttcttcctttgtgaagtagcactaaaattatatcattttatttgtaagaaataaacaaaaacgagcgattttgctgaaaatctttcagaaatgcaaaaaacaaaggaaaattcggattttttatcagaatgtgtgcgaaacgtacactaagtggccgccgctgttattcgacggcgttgtgaaaaatgctacatgaaaattgcacaaaaaactgcttgcatacccggtttgtatggtgtataataacgaagaaggggaacgatcccgcaaagcgaggattgctcccgcgaaacaaagcgcccaggagtataacgtgccggcagggcacgatgacaggttagggcaggggagtgtaatataaactatggcgaattatccggttaacaagatccgtaatgtatgtctgatgggtcacggcggcgacggcaagacctcgctggtcgagagcctgctcaatatcgccggtgtaaccgaccgcgttggcaagatcgcggacggcaacacggtttgtgactttgatcccgaagagatcaagcgcaagttttccatttccacggctgtagcgccggtagagtggaacggctgcaagatcaatctgctcgataccccgggtttctttgattttgaaagtgaagtgcagtgcgcactgcgcgttgcggagtccgcgctgatcgtcgcaaccggcaagtccggtccgggcgtcggcaccgaaaaggcatgggctcactgtgaggagcacgcaatgccgcgtatgttctacatctccaagatcgacgaggaaaactcggattactataactctctgcacaagctgcagaagcagttcggcgtatcggtagcgccgatcgttgtcccgatttttgagggcaaccgcgataccgtcggcattgtggactgcgttatccgcaaggcgtaccgcatggaaggcaacaagcgtgtcgagatcccgatcccggacaacatgaaggaccgtatcgaccagcaccgtgcagcactgtgcgagaatatcgccgagctgtctgaggacctgatggagcgttactttgcaggcgaggagttctcggatgaagagctgatcgccggtatccgtcagggtgtgaaggatctggttctcgcgccggtattctgcggcactgctgcaaccggtatcggctcctacgcactgctcaagggcattgcggactacatgccgtctcccgatgaaaagccggtcgagatctgcgaggacgaaaagggcgagctgattgagatcaactgcaccccgaacggctctacctgtgcatttgtatttaagacggtcgctgaccagtacggccgcttctcctactttaaggttatgtccggcgaggtcaagcaggatatgacgctggtcaacaagcgtgccgatgcaaacgagaagatgggccacatcttcaccgtatgcggcaaaaagacgaccgaggttccggtgatcggctgcggcgacatcggcgcggtttccaagctggttaccaccaagaccggcgatacgctttcgatgagcgttcgcaaggttgagcttgagccgatcgagattgcgccgccgtgctacacgcaggcaatcgcgcctaaggtaaagggcgttgaggagaagatctccaccggtcttgctcgtctgcatgatgaggatccgtccttcgataccgagttcaacgcggaaaccaagcagcacctgatctccggcgcgggcgatattcatctggacgttctgtgctccaagctgaaggataagtttggcgtagaggttacgctgaccgacccgatcgttccgtaccgcgagaagatccgcaaggctgttacggtagaaggcaagcataagaagcagtccggcggccatggtcagtacggccacgttaagatggaatttgcaccgtatgccgagggcgattacctgttccaggagaagattttcggcggttccgtaccgaagaacttccatccggcagttgacaagggcatccgcgaggcgatggagcatggcgttctggccggctatccgatggttggcctgcgtgcaaccctgctcgacggctcctaccacgatgtagactccaacgagctgtcgttcaagatggcggcccgtctggcctacaaggctggtatcccgcaggcaaatccggttctgctcgagcctgtctgctcgctcaaggttgttatcccggattcctacatgggcgatgttatcggcgatctgaacaagcgccgcggccgcatcatgggcatgaatccgctcgacggcggcaagcaggagatcgtagccgagtgcccgatggcagagcttggcgattacgcgatcaagctgcgctccatgacgcagggcagaggttcgtttgtttcccagttcgagcgctacgatgaggcaccggttccggtacaggaaaaggttatcgcagcgaataaggctcgtctggaggcactgaacaaggaataacattccctgcattttgtgaaattaaaaccggctgcgtgagcggccggtttttctttgggaaaattgagatgtaacgatacgaaaatggaaaattgaaaatggagaatggaagatgaaatgtaatcgtagggcggggcactccagtataacgtaatctttacgttcattctcaattctcaattctccattctccattatgtcaatcgaaaaattaacttgttgaatcattgggctttttctcctataatgagatttgaaaggggtctgcccatgaagaataaacgaatgcgctatatatcgataacggcggctatcctgctggtttttgtgctgctgatgctgctgttttccaaccgatcgggagatttcagcgcaatggaagcgcaggacggcgtactggatgcaacatcagcggatttctcgtcggcagtatatgagatagacggtgaatggacgttctatcctgaggtgctcggcagcggcgcagagctggacgctgcccaaccgggagaacgcgacgaatccattccatacggctcataccggctgaaaatacacgcgcagccgaaacaatacctgacactcggcggctactcattcgattacagcacgcgcgtgctggtaaacggcagtaaagtgctcgaaatcggcaaggtgggggcgtctgcggcggagtctgagccgcgcatcgactacatgctcataccgatttacaccggtgaggatggcacggtcgaggtggtctgtcagtatgcgaatttcgtgcaccgcgaaggcggcggtctgacgcagatgcacctgtccaccgcggagaacatcgatcgcatgcgccgaagccggaatctgtattccctggtgcttggcggttcgctgtgcctgttcggcatgtattttctgctgtttgcggtctttcagggcgagatcaagtatgttttcctcgcggttatctgcgcgctgctcggcctgcgcgaccagaatttctatgtgctgcatctgttgcctgcaaattacaactgggcggtcgcatatcggtttctggtgctgatgattacgctgcagccgtattttctgctgcttttgctgcaaagcctgtacgaaaagctggcgaagccgatcgttgtgcggtgctatgcggtgctgtatgccgtgctggcggcggcgcattttatcctgccgacgcaggatatcgcaccgctgagcaggatcgggtactatctctcgatgccgtttttcctgtatctggtcgtgcagctgattcggcggttctggcgtatccggcggcttgagtgggacgacgtgctcgttctgctcggctatctgctgctgctcgggtcgaatgtatacgaggcggtattcggccgcattgtgacgaccattacgcgccacggagcggcaccgccgtatctgctggtgttcgtattcctgatcgcgggagccatcagtttgaagatcaaccgccgggaacaggagctgtccgagagccgccgtcagcgcgaggtgctgacccagctcaaccggctgaaaagcgaattcctgcaccagatggcgcacgagctgaaaacaccgctcacggttatgagcggctatgcgcagctgaccgactggcagcttagcaccggagcggtcagcgcggacgcgcatgaacacatgcagaccatttcgtccgaggcgcagcggctttctgcgctcgtatcgcggctgatcgacctcgccaacggcggctcacccgatattgagatgggcgtcattgacgcggcacagctgctgtccggcgcggtggatgtgtgccgtccgatgctggaaaagaagcacaaccggctggaaagcgacagtggagagggcattacgctctggggcaatacggaaatgctgctgcaggtgctcatcaacctgacggtcaatgccaaccgtcacacggagaacggcgtgatcgcctaccgcattgcggacgagggcgagtgggtgtgcctgcgtgtgagcgacaccggcagcggcattgcgcccgacctgctgccgcatatctttgagaagggctgcagtggtgatggaggcagcggtatcggcctgacgatctgcgcggacgcaatgaagattcaccacggcttgctcgaggtggagcacaccgatgcagacggcacggtgttccggctcgaactgccgaaaaagccgctcaaaacacaaggagagaacgattgtggaagataaactgattttgctggtggaggacaacccgcacatcatggcgatcaacgacgcggcactgcacatgcgcggctaccgcaccctgcaggcggaaactgcacacaagtgccgggagctgctgtgttttcacgcggtggacttgatcgttctggatattcttctgccggacggcgacggcgtggcgctgtgccgcgagatcaagcaggaatacgatgtgccgatcctgttcctgaccgctatgggcgaaaatgaggatatcgtcaagggcctgaccgcaggcggagacgattatctgacaaagccgtatgatctggaggtgttcatggcccgcgtggaagcgcgtctgcgtgcggcgcacccgaaggaacgcgcagtacggcttggcccgctgcagatgaatctgctgagcggacgcgcgtacatcggagagaccgacctgaacctgacgcagaaggaatttgcggcgctgctgtatctggcgcggcacccgaaccgtagcgtcagcgcgcaggagctgtacgaggcggtctggcagcagccgatgggagccgacccgcatgccgtgcgcatgacgatctcacggcttaagcagaagctcggcggcgaggatgcgagggtcacggtcaattcgtaccgcagcagcggatatcggctcgaggagcaatgattgaatatttacagcggacggcgaaggtaacaaatttggtaccttcgccgtccgccgcctttttgcccttatactgaaagtacggtgaaatacctgtatcctcggacggtgctccgcggtaaagcaaggggaaagccgtggaaaccgtttatttcataaggcaaggaggaagaaagatgaaaaaacgaatttgcagtttgctgctgatatgcagtatgctggcgggtctgctgccgcagatcgtgctgccgcaggcggcggcagcggatactgctgcagcaacagacggctttggtctgcccacggaagaaaaaacgggcataacagacaaagccacacttcgtaataacccatacggcacgttgggatgggttccgctgttccagaaccacgagctggttgtagccggtgtggactcggatgagttccagacgacatacgagggcgcagccaacggcaagggcagtcagatgtctacgttccggtggagcaactcgaccgaggtcggcaatgccgagcgtattgcgactgtggcgtttgatccgaacggcaccggcaaggacgagtacattgcgaatctggtatttgataaaagttcggaacggcttcgtctgtatgtgacgaacaaggaccgcagagtatcgaacgttgttcagattggtgatggaaacgacagtgaatacatcaagaaactgaaattctaccagacccgtgctatgctgagtctggccgcaggcgactttgacggtgacggcaaggacacgctgctgatctatacgccgggcaacaacggtagcacagagacggtagacagcattaaggagtatacgttcagcggcagcaaactgactgacaacggtcgcgtaatcaacctcggtgacgtcatcgacggcggccgagacgcgctgaaggccatgctgtaccacgacggcaacggcgataacgagctgcgcgcgcatctgagcgttgatatggaagtcggcgacgtggatatggacggtatcgacgagctggcaatgacagtcaatgtcaatgacctgaaggagacatcgtatgacggtcataccgaactcgagaaatcctatctgacggtctacgattacaatgataccaataacgataataaatggcagcagatgatgaaaaaaacactgctgagtagcagcgacggcgcaaaaggtcgtgctcgctttgcgggtgtaaccatcggttatgtcagcgatgcgccgagcggcagcatgccgccggaagttgttgcggttggctactacgataagaatggtaattatcaggactgcgactttgacaagagcaagctgctggcgtacagctatcagtacagcacgaacacgaaggataagtcgtggacagaaaaatgcaaggcaacagaagttgtcaccaatggctttaccaataccggcaccaagggtgacgatgtgcagaatccgatcgcggtagcggctgttgcagcggacggcgtgaactcccaggaatatctgttcatttccggcagtatgtataaagttgacccggcgaacggcaagcagctgtctatcctggaaggctcggataagggccatgaccgctggctgggcggccgactcatcaacaacagcggtattctggactatgctgtcggcaattttgacggcaacaagcagggcatggaacaggtatactacgttgagtaccgcaagcaggagaccttcgacaagcagtttttgaagattggtcagctttacaaagactcggctggcagcaagttcagccgctgggaggatgactggacatactatgacaagagcaactgcaatctggcgcttacaacggcagatgtaaacaacgatgccatgctcgcgaagatcaaaagcgtcagcaccggctacaccgacccgaaggtaatggcgattctggaggcgtcgccgcatttcgctgaggtgaatgacggtgatatcggaaactcgcagaccggaatcggatacagtaaggataatactgtagcagtaacggcatccggttcgtttggttttgatatcatggcgggctttgaatatgttgcaccgctgattgagaccggcggcggtgttgaatttaataccagtcatacctttactgttggtgcaacaaaatctacaagcaagaaaataacggtcgagtattctaatgatacgaacgacaatatggtgctcatgtatgcaacaccgatgacatattacgagtatcaggtgaagtatccggatggcacaaagaagggcaattcgccgaagctgaccagttctatgacgctggcggttccgggtaatccttcgatgaacatggtttcggtagatacttataataaggctgcttcggcgtacgaggatatgcagcagattggcagcaacctgcatctgggcacgtccggtcagccgaatacttatcgttccagtctgccgagcggttcacattcggagcaatccggtaaagttggtcattacaaagattcgggtacacagctgcagagttttacggctgcaaccagcagcggcgtaacctttgattacacctatgagggttcggtgcagatgtatggtgtagttggcggcttcaaggctggcggcggttatcactggggagcaagcgccggaaccgaaaaggtaaacactgaggagattaccaagctgggctctgttaccggcggcggcgattcgcgctataactttgactggagcttcggcacatggacggtaccgttcaacggcgatgaagtaccggtactgggctatgttgtcagcaatgtgacggcaccgccgtctccggcgcaggatctgtcgctgagtgagcagaccaccaacagtatggtgctgtcgtgggaatccggcgaccgtccggcggagtattacaagatttaccgctacattgagaacaataagaataagccgttcgtattgattgacaccgtagacgcatcggaatcaccgagtggtgaatatgcgtatcagctgaaggatcttgcgtcgaacgaagagtatcagtatacgatcacttccggatattataccagtaaggaagagtcggttgaaagcgagatcgttgtcggcaagacgctggcgaatgagatgagccgtccgattatcaatggaccggacaaagtaaccgttccgctgaacggctcgacaactttccgtgtgcaggcttcgactccggcagaattttcgagcacggattatcagtggcagaagcgtctgccgggaagaaagtggacggatattgaaggtgctacgcaggacacctataccgtaaagtcggtaacgagcgaactgaatggtgcgatgtaccgctgcgtggtaacgtgttataccaagtcggcaacgccgatttcgttctacagtgatgcggcaacgctgacggtcggtacaccgcaggcaaccgccggtttgacggtatccggtactttggagggcagcggcgctcaggataccccgtatatcggtcagagtaatttcaacacggttaaaaccacgacagaatccgtagagacaaccgttccgtgcaccgtagaagtcgatggcatgacgctgaatgtttacgcagtaagcaatcaagcgggtgcggtacagggatatgtcggcatcgatgaaaagaaggaaacaaacggttcgatatcgaccgtatactacgccgtaacaaagactggcgagaagtataccgcaggttcggaactcaccatggagaccacctatcagtggaagaacagtggtgcagacgcagcagtgccgggcacaattacgccggaaaccgtagtgatagacaaaaacgaaaacgaaaatgaaaacgcaaaagcaaaagcgtttacgctggacagtgcaacgaatgcaccgacagacgcggaatacgacgaaagcaagtaccggaacggcgagcagtacctgattcacggtaaggatactgtgacggagaacgaaactacgtttgaccgctatattctcagtacaatggctaagtcgaccagtggtagcgccggtgcggaagaggacacctatactgtcaagtattatcagctggtgaagaaggcagagaacagctatgaccggaccgagctgacctgcacacagcagacgaagctgggcagttatacggatccttcgttcacactggtaacaaaggaaactacggttgaaaataaggttactacctctacgccgggttctggtacggcgctgaccctgacgacgaaaacggcggaaaagaacggcgctgcactcggcaatgtggagtacacgctgacgattacgaacacgtcggacggcacggtcagcacgattgtcggcagaacagacagcagcggcacggacagcaaaacgtggaccgcaccgacagccggtctgtatgccatcacgaccaccgcgaccggcggcttgacaagtgatacggtatattatctggcaggcgtgcagagtgtagagaacggcgagaccagcacaacggagaccgtttacactcttgaaagcactgttggcaaagaaaacaagattacgagcgtatacggtacgccgattgatctgagcgtgcagcagcagactgtaacgaaaaacggaaacaatgttaccgcaggcaacaaaacagaggttacggaaaatatcacctacacctggcggcagtccggtcagagcgagggtaaggaaacggctatcaatggcagcactttccgaccggagaaggcgggaacctatatcatcacggcataccagaattacagcgatacttccaagcgcaccaagctggcctccacgaccattacggtaaagcgcaagccgctggagctgtatgttacttggccgggagataatgaaaatcataattcgaccgaagcaccggacagcaagagcgcattggtggtcaaggcggatgcgctggagacaggtgactccctgccgtcggcaattacagccgtatgtgcgctgtatgatgacaagggcaatcgaaagaacgtcagcggccgctttgaggtaacgattgcggtcaacggtgaggacgcggctgtgaagtcgctgctcgagaagtacgagctgaatctgaccaagcgcatgctggttgtcaagcaggacaccctgagcgtaacctatcgcgccggtgaaggcggctcgcttagtgcaagctacaaaagcggcgaccttgaccagaagtttgaaagcggtaagaacatcgctaagaacaccaggctgatgtttgatgccaagagcaacgacggtttccttgtaaaggaatggaaggtcaacggtcagtccattaccggtaatacaaagtacaaggtgacggagattctgtcgaacggcaaaaaggtcggcgaacgactgacggtagcggcgctgacggaaaagctggacgtagaagtatccttcagcagtgattcgcatacgattaccttcagcagcggcgaaggcggtaagctgaccgcagcactgaaggacggcggtgcagtcacgaccggacagaagattgcggaaggcgcaaatgtgacgttcacggctgcgccggacagcggtatgtcggtagcacgctggatggtggacgaaaagccgtattactggccgggtacgaccgatctgtaccgtgagtccacgctgacactggaaaatgtgcagaaggaccgcaaggtagcggtagagttcagcaaggcaggcacctataagctcaccttcaacatcgagtcggaaaccggcagcaccttgccgtccgtgcagacctcggcgaagctggcagacggcactgcggcagatctgaatgcggttccggacggtgcggcagtaacgtttgcactggaaaatctgggcagcaactacacggtcaagacgtggaaggtggatggtaaggaagccgcaaattcgggtacgcagaagcagtttacgctgcgcaatatcatgggatcgcatacggttacggctgtaatcaatgcggcgcaggaggtaacgctgaccttcaaggcagtggatgcaaagggtgacctgataaacgcagacattgcttccgttaccgcaaagattaaaaacggcaatgcgattaccaacggcagtacggtcggcaattattcgacgattgagtttgctgctgcggtaaacgagaattactacgtttctaaatggactggtgcggaagctgatgcaaaggattcgacaaaggcctccatcgcaagtctggaaaagaccactgaggttatcgcacatatcgcggagaagccgcaggtgacggtggcagctgctgagaacggcgcggttacagtcaagggcacgcgcgtgaacgaggtatctatcacgaaggacagtatcaacacgcatgttgattatgacagcgcgattaccatcacggcggagccggaggaaggctactacgttaagagccttaccgttggcggcaagacgtttgattatgattctcagaatacctatcagtcgggtactcgcacggagactgtaaagaatatcacggcagataccgcggtgacggctgtgttcggtaaggaaccggttatcgtgttctccggcacatatgcggatattaccgcgcagaacggttcgctgaacagcggcagctttgtattcatgcacacgccgatgctggaattcctcgcggcgccgcatttcggttacgagctgacagcatggacggtgaacggcaatgcaatcacaagcgggattgagcagaagccggaggagaagcagctttgcaagctgaccggtccgattactgcagatcagaccgtcgttgttacggcagccgagatcccgcagtacgacttcaacctgtccgttgattcgctcggtgacgagggatacggcggcatggtttccgcagaaatcacccgcaagggcatgagcgcatacgaacaggaggacctcgaagcaggcacgcaccacagcttctaccgcgactcggatatcacgatcacggcggtgccgaacgcaggctaccgcgtacaggactggaccatcaacggccagaccacagcggataccgcagtgagcaagaagctgtacaatctgcaggatgaaacgacggttcaggttcgctttgttaagctggtgaccggcattaccttcggtccgacgcacgaaacaagcgaaggcggctatatcagcgcggcagaggcgaatgaaacgtctatcctcggtgatgcggctaccggcgcgaatattgcggcaggcgtgccgatcaagttcacggcagaggtaaagcctggttacgcaatcgaaggctggtacgtcaacaatgtgcgtgatgacagcgcaggcacaggcgaaacctacacctatccgaacacgaccagtgcaaactcgatttacattgcgccgaagttccagcaggtcaagtacaacatcaccactggtgataacgtcaccgtaaacggacagaacagcacaaccgcacgcggcggcgagtcgctcacctttacggcagtaccgccggcaggtcagaatgtgaccggctggacagtcaacggcgaggcagttgccggtaacggcaatacgctgacgtggacggtcgagaacggctgtctcacgaagccgaacgtaacgtcatatcatgttgaagcacagttcagcgcaggagagtacaaagtaacgtacagccagccggcaaacggcacgctgagtgcatcggttgcagctggcacaccggtcaacggcggcactaaggttgccttcaccgcagaacccgataagggttatgagattgacgagtggacggtaaacggtcattcggttgccaacagcggcagcacctacaccctgaacgtaaccgaaaacagcacggttgcagtcaccttcaaggcaatggttccggtcagcgcagtgccgaacggcagaaacggcaatatcgccatcaccgcaaacggcaagacgatcacggacggctatgtttcctccggttcggacgtaaccttcaccgtaacgccggagaatacagacgatatggtgcaggcatggcaggtgaacggctcgacagtcgctgagatgaccgatacggcagatgcaccgctcacttatacggtcaagaatgtaaccgcaaagactgaggtttccgcaacgctgattgagcgcccgacatacaccattacggtaacaagcgagggcagcggtacggcgtcggcagaaccggcaagcgtcaagcgcggcggcagcacgactgttaccgcagtaccgagcagcaatagctactatctcaaggaatggtcggttaacggcggtgctgcacaggctgcatccggcaatacgctggcactgacggaaattcgcagggatacgacggtcaaggccgtatttgacggcgcgatcaactacgatgtaaccctggatgttcaggatgcagataccggcacaacggttgctgcagcggcaaacggcaaggccattacgccgcagaagaacagtccggcaagtgttacccgcggcagcaagatcgtattcacggcaacgcctgccgtagaaaacggacgaaacaagcagatggtcgcacagtggatggtaaacggtgtagatcagaataacatctctaacgagctggttatcccgagcctgaccggcaagaccgatgtagctgtcaagttcgttccctacaaaggtttcgccattccgaccggcggcatcggctggaaggtctccgatgtgaagcgtacaccggacgataccaagccggagactgaaatccgcaaaaacggcgatctgacattcacagtcggtctggcaggtgactacacggtaatcagcaagctggtcatcaacggctacgactgcatcaacggcaaacttgccgaacatgcaacgctgcatggctgtgacgcagtggaagccaggaagaacgcaaacggcagctacaccgtcacgatcaagaacgtaacggcagtgccggatatgagcgtagaagcacatcgggtaatcatcggcgatctgaccgttccggagaaattcaaaaatattccggaactggatacggtcgaaaagattcagacaaagctggcagcggaactgaccggcaggaaggatggcgtggcattctacgacatcgcgcttaaatactatgacagcggcaagtggattccggtaaacgaaaacaacttcccggcggacggtgtagacgttgttctgccgtatccgaacggtacggacagcaaggataccttccaaatcgtccatatgctgaccaagaccggttccgagggcaagatcgagaagtttacccatatcaccaaggagaccgatggtctgcggttccatgtaaccagcctgtctccgttcggcgtaagctggacgaagtataccgcgccgacgtcgggcggcggcggtggcggcggcggagccgttgccccgaccacctacgacatcgtgatcccgtccgcactggcgaataccgtcaaggcggataagaccaaggcggccgcaggcgacaccgtaacgctgactgttgccggagaaggtacgctgactgtcacggacgtaaacggcaagacggttgccctgaccgatctcggcagcggcaaatacacctttaagatgccggcggctaaggtcagcgtgggcttcaagactaccgcagaccagccgtgcgatggcggcaaggattgtccgtccgcaccgtttacagatgtagatactgcaaagtggtatcatctgtccattgattatgtgctcacgcacaaaatgatgaacggtgtatcgagccgtgcatttgcaccgaatgccaacctgacgcgcggtatgctcgtgcagatcctgtataacctggaaggcaagccgaagggcacagcagcgaacttctcggatgtgcaggctgacgcatggtatgccgaagcagtcggctgggcagcgtccagtaaggtcgtaaccggctatgcagacggtaccttccgaccgaatgcagccgtcacccgcgagcaggcggcagcgatcctgtatcgctacgcccagagcaagggtatcgacgtaagcgtgggtgagaataccaatattctcagctatgtggatgttcagcaggcaagtgagtacgcgattccggctctgcagtgggcagtcggcgcaggcgtgctgaacggtaagaatggcggccgtctggcaccgaccggcaccgccacccgtgccgagatcgcagcgatcatgcagcgctggtgcgaaaacatcatcaagtaacggcagacaaaacagcaggacagagaaagggctgacccgacgggtcagcccttttttatgcggttgaataatggagaatggaaaatggagaatggaaaattgacgtgacgattttctgttgcgtgggcggccaatgaccgcccctacggttacgcgtgtgcaggttgtttgatacggtgcgccgagtcgtcgcaccctacggtatagtcttacatcagatacaattcgtagatgccgtccgtaacaacgcgcaaacgagttgcgcaacactgttatgttgcgcctacgaagagtagctggtatgtgtagaagcaatgtatctggcactgcgcagaggtagagaaatgggagcacactgtgctcccctacggaagaaaaaatcctctgccgttctccttttcgaagcggtcgccgctctccgattttcgctagactatcccaaagggaaaggggtgattcacaagagggtggaaaccttggtgtctaccctcttgtgcccctgccgggcaggcaagattcgttcgcttcgcaagcgattactctgcaagcatcgctgcgcccaccagacctgcgtcattgccgagcgacgcacagacgatctcggtatttcggtcctcaccgcggaaggtctgcgggaaagtgagcatgcgcagcggctcgagcagcttttcgccatagcccgccagtccgccgccgagcacgatactctccggctggaacagattcacaaaacttgccagaccgttcgccagattgccgcagtattcgtcgaacagctcctgcgcgagcgcgtcacctgtgtctactgcatcgcagatctgcttggcgttcagctgacccttgtgtacggcaagcacgctctttcgtccgtcctcgagcgcacgctcggcaaaccgcacgagcgaagccgccgagcagtacgcctccagacagccgtgccgtccgcagttgcacggctcgccgtcttttcggatcaccatgtgcccgatctcaccggcaatgccgttgcagccggtgtacagctggccgttaatgataatgccgccgccaacgccggtgccgagcgttaccatcagcatgttgcgcgtgcccttggccgcaccggcagtcgcttcgccgagcgcggcgcagttcgcgtcgttatccagatgcaccggacagccgaactcaggcaaaaacgcatccgcaaagctgacgttattcagacccagattggtgccgaaccgcagggtgcaggttttcttgtcaaacgagccgggcacgccgatgccgatcgccgttacgtcctctaccgcacagctgtgcgccttgcacagcgagagcgccagcgttttcatatctgctttcaggccggctgcgttgccggtccgggtcggaaggctgtccttgcacagcagcgtgccgtcctcggtgcagagcgccgccttgacggtcgtgccgcccagatcaataccgattctcacagcaaatcctcctcgtcgaacagatgcaggccgcggcccttgaaatagttgttcagccgctccacactgctgttgatgatcagctcctccgggaaaccaatttcctcgagcatttccagtgcgccctccacatgaccgacgcggtagcagatatggctgtcgctgtccaccgagataggcacctcatacttcatgcacaggcgggcgatgtccatgcagttgtcatggctgcccttacggatggacagagatgcgttgttaatttctacaatcttgccgtggtcgttgcagcggctgatgatgtactcgtggtcgaacgggaagttggagttgccgaggtggccgaacgcgttgacatacgggttgtacaggatggcctcgagcgccgccgtgtgcacgctgctgtccgccggcgggaacatgcactcgtggaaggacgcgagcgcaaactcaacgggcttgagactcttgttggaaatgacgttgatgccgcctgccggagcggtgatgtcgaattcaatgccgcgaatgaccgttaccttgccaatcttgcgcgggataaggtccaggttggaaaaatgccactcgtgcgggccgtccggattggtggggccgtggttggtgatggcgatagccgcaagaccgcggtcctcggccgcctgcaccatttcggtgagcgtgctgaatgcgtggtcggttacattggtgtgggtatgcaggtctgcgatgatttgcatgggaaaaggctccttttgacgtatgattttttggggtaagatgaaaggcggacacatgggtccgcctctgtatttgcagttcgctgaaccgccggtatgcgattgtttatcggcggtgtctgcgcggataatcatcgttatcgtagcgcttgcgcatcgccttgcggcgacggcggcgccggattccgccgaatgtgatgttgaacagaatgtacagcacgataaagattgcggctgcgatcagcacgattttgaacacggtgctctggaagaaatggctcagcttgtccgagtaatagagtacgcggctcatttccacatcgctgagcgcgaccagttcgaccgtgccgtaggacgtgccgttgtagctgtatgtcatgctgccgaccacatcaccggccttgatgggcgcgtcaacggcttccggcagattgggtgtcgcttccagcgaatcggtctctacatcggcagggagcagcgccaccagatcggttttcgcggtcagcaccagctgatcggtctgcgtggacaggtccacctttacatgggcgagcgtgtcgccctttttcgcaacggtcttggtcttaaagtgggtgaagccccactgatacagcgatttggtatccgtgaagctggccgctaccgtcgggtactccttggacgaggcggcactgccgagcacgaccgaatacagcttggcatcgccgtactccgcgtagccgacaaagcagttgcccgcctgcgaggtatgtccggttttgatgcccttgttgtacgggtacgaccacggattgaacgagctgaagatgagctggttggtggtgaagatgatgcgttcctcgtgcatgttggtcttgggcatgcggtactgcacggtgtcgataatgttggtgaacgtgtcgttcttcatggcctcgcgggcaatgaggtacagatcacgggcggtggtgtagtggtcttcttcgtgcaggccgcatgggttgcagaaatgcgttccggtgcagccaagctcctcggcgcgggtgttcatcatgtccacaaagtgctcgctcgtgccgccgacatggcgcgcgagtatgtacgccgcctcgtttgcggagggcagcataagcgcatacagcaggtcgatgacgcgcacggtctcaccgaccttgatgcctgcgttcgagctgtctgctgtaaccttggcgaagtcgccctgctcggctgtgacggtctcgttcagatcctcgacattctcaagcgtcagcagcgcggtcataattttggtcgtggacgccggataccgcttttcgtccgcatttttctcatacagcaccatgtcggaatccgggctgatgagcagggcggcggtagccgttacggcaggcgcttcacttgccgctgcggtaacgtccttgtcgttgtcggcggtcgcgtccttggaatccttgctgtcggcagaatccgtgctgcccgaatcggtggacgaggtatccgcgctgtccgaatcggtggacgaggtgtccgtgctgtccgaatcggcggacgaggtgtccgtgctgtcggaatccgactggctcgatgaggtattactctcgtcattcacggcataagcgcgggtgatcggcgccgcaccgagcagcagcgtaaagcacagcgccagtgcggtaagacggtttttgaaattattgctcttcatcggtatctcctaaagaaaaatcggcatcggtgaagtgcccgcgcagaaccgccggcttgggcggtgtgcgccgcagcggatcgtagcggaaggaacggcagtgatcggtgccgtttaccacaccgcgtttgcggcaggcaatgcgttcgccgtccgccagcggagagccgtgcgcgcagtaggtgcagcgcggttctatattttttcgcagcagctttttgagcctcatgcgtggtcactccagtcgtgataaaatcaggtgaaaaagtgtccgacaggatcagtatcggcggacacaagacatatataaatattatatatcattttctgcgctttttccacccccaaattggatacaaagcggaaacgaacagcacagcaagcgtataccggaaccgtaccgatatcggtgtcagctccggtgaggaaaccgtcaacacggcaggcgagagggaaaacaggaaagccgtcagcacagctgcgagcgtaccgtgcagcagctttgcggcaaacaggccgcgcaccggcaaatcgtgtgcttccgcgagggcgcgcacctgaaactgcacagccagtccgccaaatcccagcaggaaggacgcaagcgtcagccgcgccctgcgcggcagcggcagcactgccaactcgtctaagccgttggtcaactcgatcatgccgttcagcacatttccgttaggcaaaagtgcaaataccggcgaaagcagccgcagcaggatggaaaacatggtcagaaatgccgtcacggtcagcgccgtggacgctgcctgctgtacggacgcgcagaaaatcgaggggaatgaggtgcggttccggttatggatacgctgcgacaaggcggataatggggtgcgcgcgaaaaacaatccgacgatcagtgccgaaacgatatgtatcccgtacagcatcgcgcctgcctgcgcggagccgaacacgccgagaccaaccagtccgatgcagaagcccggactggcgcagttgcagaaccggttcacgcgctctgccgcttcgcgggaaagcacaccctcggagagcagcgcacatgcggtcgcggcgccgaccggatacccgccgatgagtccgagcaccagtgcaggcgcagcctcgggcggcaggccgtataagcgggcaagcggcttcgccagcagcggtgacagccgcgcggtatcacagcggacaagcagtccgctgacaacgaaaaacggaaataaagccggtaaagcctgcactgcggctaaagaaagcccctcgcggacaccatccgcgcaggcagtcgggcaaagtaaaaacgcggcaaaaagagccagcgataagaacagcttcatagcgtcacctcggaacagtgtatgagaagcaggaaagtttcagtacgtttatacataacatataccgttatacctgatataccgcagggcggggcaccctcaccccgccgtatctgtctggtctgcacaatctatcccgtaggggagcacattgtgctcccacgcaacgtgaaatcatgcggttttggccgttccttgtgcagactccggtcgcgttgcgggcgaacactgttcgcccctacggctacgcatctgcaaatgagttacacggcggggtgagggcagaaggtgaattgcggcaaagccgcaagagaagccactctggagtgcctcgccctgcggagaaggtaaaatgcgatatgaaggtggcgcaacatgctaaaagataacttatacgccgaactcatggaggacctccacccaaaccgcccgcgcgtagaaatcctcggagacagccgggtgatcgtggagaaccactgcggcatacaggaatacgatgacagcatcctgcgcgtcaagtgccgcgggtgcgaggtgcgcattctgggtgcggatttggagctgacggcgctttccatggacgaactggcggtgatgggcgtgatctcgtcggtggagtacatcacgaccgagtgaggaaggaggggcgcgaatgatcgggcggctgtggttgctggcctgcgggcaggtgcgcgtgcgcgtgacaggcgcaagcctgacgcggtttctcaacctgtgcgcggcgcagggtatcacgctgaggcagatggaccgcacggcatggaatgagctgcacgcaaccctgtccattcgggatttccggacgctcaggcggcacatgggccgcacgggatgccgcgtgcatattctacgaaaacgcggtctgccgttccttgcggcgcgtctgcgtccgcgcacggcgctctggggcggagccgtattcgccgcagcgctgtgctggctgctcggcacgcatgtatgggcgatacagaccgagatcgcaccggcgatagacgaaacggctgtcatgcagcagctgagcgaaatgggcgtgcgcatcggcatgcccatcaagaagctgaacacccgtcagatacggtggaaaatgatgcagctgcagccgaatatcacgttcttttcgcttaatctgcggggcaacagcctgaccgtggtcgcctacggcagtaccgacccgccggaggtgctggacgagcacgccattaccaaggtggtggccgcgcgggacggcgtggtaacgcaggtgcgtgcgctcgagggacagccaatggtgcgggcaggagacgcggtgcagactggcgatacgctcatcagcggtcttgtcgagccaacacgcgaaggcggaaagtaccgtacaacgcatgcgcgcggcaccgtgcaggcgtacaccacgcatacggttcaggcggcgcggccgctcaccgagcagagcaagcggtatacgggtaaaattcgtcatcaatatgcactggtgatgggaaataaacggttaaatttctatattggcagtggaattgcagggggtacttgtgataaaatagtaacgaccagacgtttttggctgtcggacagcgtggtgctgcctgtggcgctggtcacacaaacgtatacattctacgaacgggagccgacgacgcgcaccgccgaggacgtgcgggtggatatgctctcgcgcgcactgggcgagaccgccgcggatatcgacggcatggtgacgagccacagcgaaacgttcaccgagcagaacggcgcggctgtgctgtacctcactgtccacgccgaggagcagatcggcaccgaggccgtggatgacagtgccgttccggaggaaaatgcggagatggaacaggtgccgtagagacagaaaaggagacgcctatgaaccgtaaactcacgacgattctcgcaggactgagcactgcagcggcgtttgccgtaaatggctcggactggcttcacggcggttccgcgagcgtaggcaaattctgcgtcagcgcggtgtttatcgtgctggtatcgctgctgctgtacgaatggcggaaaagcaatactgcaatgtgcctgctgacgattgcatcggcgctgattgcgattggtgcggcagccggtttgcttatgacgacggatatccttccggcaaattcggtgctgctgccgtttatcgtgttcctcgtgccgtttttcggtgtgacgaatttcatggcttccgcatttgccgcaatgcttctgccgctggcggtttcggtggtgtggctgtgttttgcggtggctttctgggtaagcaatcggaaaaacgcgtgattttatattacgtgggcgaacaatgttcgcccctacggttaggcgatgagcagaccgtttacaacggtacgccgagtcgtaccccagggcaccttctcttgcggcgttgccgcaattcaccttgccgcaccctacggtaaaacatcatgtattgctgcagatatatgaaaattaactgtatgtaaccgcatgcaactgtatgttgaacgagttattgcaacagatacatacacttgcatacagtttatttgatagataaacactatccgcagaagagcaggtaacgacagggaaaacgcctgcctcctgccttgcacggatgaaaactaacatttaattcctaactctaattactaattaaacataagagggtgtaaccatagaacaggtaatgcaaatcgagcagactgaactgctgatggcagtattcggtgcatttgacgaaaacatcaagcagatcgagcgcgaactgaacgtctcggtcatcagccgcggaaccgagctgaaaatcaccggcgaggacgaaggcgtgtccatcgctgcccgcgcgatcacggcgctgctggccatggcaggccgaggagaatccatcggcacacagaccgtgcagtacgtcattgggctggcgaaggacggccgcgagagcgaggtccacacgatgagccgcgatgtgctgtgcatcacggcaaagggcaagccggtcaaggcgaaaacgctcggccagaagaaatacatggaggccatccgcaagaacaccatcgtcatgggcgttggccctgccggtaccggcaagacctatcttgcggttgcggcggcggttgcggcttttcgggacaagcaggtctcccgcatcatcctgacccgtccggcggtcgaggcaggcgagaagctgggcttcctgcccggcgatctgcagagcaaggtagacccgtatctgcgcccgctgtacgacggcctgtttgatatgctcggcgcggaaaacttcaccaagtatcaggagcgcggctccatcgaggttgccccgcttgcgtacatgcgcggacgcacgctcgacgacagcttcatcatcctcgatgaggcgcagaacaccacgcccgagcagatgaaaatgttcctcacccgactgggcttcggctccaaggcagtcattacgggcgatattacccagatcgacctgccggacggcaagcagtccggtctgcgcgaggcgctgcgcgtgctggacggcgtagagggcatcgcccagtgcttcctgaccgaaaaggacgttgtgcgccatgagctggtgcagcgcatcgtcaaggcgtatgcagagtacgaaaacaaaaagggcaaaggcaagcctgccgcaaaaccggcaggaaagcgccttccgacccgccgcaaggagggaaaatgatgaatcatcagatcaatatcggctttgagaccgaggtagcagacgaaaacagcgtgcgtgagctgattcgcacctgcgcggagcgtgtgctggcgagtgagcaggtggactttgacgccgaaatcgacgttaccgttgtcgatgccgacgccatccgcgaaatgaacgccgaataccgaaataaggacgccgtgaccgacgttctctcgttcccgatgtacgagttcctcaacggcgagccgcaggaggagctggaggccgaaccggactccggctgtgtcatgctcggtgatatgattctgtgctacacgcgcgcctgcgagcaggcggagcagttcgggcactcgcctgcaagagagtgcggctacctgaccacgcattccgttctgcatctgctcggctacgaccacgagcgcaatgacgaggacactcgcctgatgcgcagcaaggaagaggacaaccttgcgttcctcggcctgacgcgggactgagccatgaaaaagaatatccgaaaactgagcgagagctttctgcacgcgttccgcggcctgcggctgtgtatccgtgacgagcgcaacttccgcgtgcacatgacggcggcgttctacgtcatcctgttcggtgtgttcggcggcgtgagcatgaccgaagcggccatcctgtgtatctgcttcggccttactatgggcgcggagctgctgaataccgccatcgagcgtctgtgcgacaagcaggcgagcgggtatgacggcatggtacgcaacgcgaaggatatcgcggcggcgggcgtttttgtgtgcgcggcggcgtgtgtcgcggtcggcgcgtgtatctttatcggaaacggcgtgcttgcggcagccatcaaatttttgtggtacaggctgtggcttggcatggcggttgtggtcaccgtgccgtttgcggtttggttcgtttttcattttggaagaattcaataataatggagaatgggaaatggagaattcgcgcaaggatagctcgtcgcagcgcggacggaactcgcgcaaggatagcgacattttcaattttccattctcaattctcaattactgtactggagataaataatgagcaagattacaaaaactgcggtcgtatccgttgtaggacggccgaacgtgggcaaatccacgctgacaaacaagctggtgggccagaaggtggctatcgtatcgagcaagccgcagaccacgcgcacgcgcatcacgggcgtactcagccgcggcgaaacgcagtatgttctgctggacaccccgggtctgcacaagccgcgctcccgtctgggcgactacatgtgcaaggtggtgacggacacggtttccgaggtggacgttgccgttctggtggtagagccgatcccgaacatcggtcctgctgaggaaagcctgattgcacagatcaagcagcatcacatgccggcaatcctcgtcatcaataagattgacaccgtcaagaaggaggagctgctcgctgtcattgcgacctacgcggcagtgcatgagttcgacgcggttgtgcccatctcggcacgcacgggcgagggtgtagaggagctgctcaccgaaatcgacaagtatgccatcgaaggcccgcagctgttcccggaggacatggtatccgatcagccggagcgtcagcttgtcgctgaaattatccgcgagaagatgctgcgcctgcttgaccgcgaggttccgcacggtgtagccgtcggcattgagcgctggaacgagcgtgaggacggtctggtggagatcaacgcggtcatctactgcgagaaggccagccacaagggcattatcatcggcaagcgcggcgcgatgctgaaagaaatcggccagcaggcgcgcgcggacatcgagcgcatgctggatgccaaggtattccttgagctgtgggtcaaggtcaaggagggctggcgcaacaaccagtaccagatgcgcaacttcggctacgaggatcagtaaatggccggggtcaagctgcgggcactcggtctgcgtgaggtggatttcggtgactttgaccgctatctgaccgcattgaccgaggacggccgcaggattgaaatcctgtgcaagaacgcgcggcgcggcaaaaagcagaatccggcggcacggcagctgtgctactcggagttcattctgtcggacagaggcggcaggtacacgttaagagacgccgaccttgtgcactcattcttcgcgctggcaggcgatatcgagaagtacgcgctgtcgtgctacttaaacgagctgacaaccgctctgaccgtgccggatttcgacaatccggcactgtgccgcctgctgctgtacgcgctgtatgcactcgagggcggtaaacgcgacccggagcttgtcaaggcggcgttcgagtggcgcattatggccgagagcggctatgcgccggatttaacctcgtgcggcgtgtgcggcgaggtgatagagaacccgccggtgtgcttttccgttcgggcgggcacagccgcggacgcaaagtgcgcgaagcgtgtcggcggttatacacagcttgtggacagtaccctgcgggcgatgcttcatgcgctgacagccgagccgaacaaggtgtatgcgttcgcactcagcggacccgccagagagcagttctgcggcatggccgaggagtatgtgaagtaccacctcggacgaggattcgagagcctgcggttttatcggtcattgcagataccgatgaagtaacggcagaaaggagcatcctatgacgcacaaaacggtttccatgtggaaagtaacgagaaatctgattcttacagacgtctgcgcgatcaccttgtactggctcataccgagcgcaaagatgctcgtgctgctgcttggtgtactgtgcgccatcggatatatgctgtggctgggacggtgcttcctgaacgactgcaaggccaatctgccgggtgaggactatcagcgcattgccgccgagttcggctttatctggtgctggaaccccggtcggagaaaacagtggcagtacaccgccgaggaaagcggcgagaccggtgcggcgctgctgcgcatctggcgcgggaatatggtgcttgtcatcgtgtcgctggcggtcatggcggtgctggtttggatggggtaaacgtatagaaatgttgtagggttgcgtgggtatgtgaatgtatattggtaatccatcaacaaaaccctacgcaataggttgaaataattcctaaattataattgagaggatttgaaatgaacaaattaggcgaaaaatcccttaaaacactggaatactacgaaatactggaaaaactggccggacaggcggcctccgaggcggcaaaggagaaatgtcgcgcgcttcgtccgctggacgaccacgagcaggccgagctgtggctgcagcagaccacggacgcgaaggacctgatggttcggcagggcagccctgcctttggcggcatccgagaggtcggcgcgatcctgtcccgcgcggaccgcggcggcacgctcaacccgcgcgagctgctggctgtggcaagtctgctgcagaccgcgcgccgtgccctgctgtacgatgccgagcacgagaacaagaccacgctcacgcccattttcgggctgctctccggcaaccgtgacctggaggaatccatcacgaccgccatcatctccgaggaggagatcgcggacggtgcgtctcccgagctgctgagtatccgtcgtgagctgcgccgcgtgtccggcaaggtgcgcgaaacgctcaaccgcatgatctcgggtgagcgctccaagtacctgcaggagaatatcatcacccagagaaacggccgcttcgttgtgccggtcaaggtggagcaccgcggtg
